United States Patent
Chakraborty et al.

(10) Patent No.: US 9,597,380 B2
(45) Date of Patent: Mar. 21, 2017

(54) TERMINALLY MODIFIED RNA

(71) Applicant: ModernaTX, Inc., Cambridge, MA (US)

(72) Inventors: Tirtha Chakraborty, Medford, MA (US); Stephane Bancel, Cambridge, MA (US); Stephen G. Hoge, Brookline, MA (US); Atanu Roy, Stoneham, MA (US); Antonin de Fougerolles, Brookline, MA (US); Noubar B. Afeyan, Cambridge, MA (US)

(73) Assignee: ModernaTx, Inc., Cambridge, MA (US)

( * ) Notice: Subject to any disclaimer, the term of this patent is extended or adjusted under 35 U.S.C. 154(b) by 0 days.

(21) Appl. No.: 14/043,927

(22) Filed: Oct. 2, 2013

(65) Prior Publication Data

US 2014/0147454 A1    May 29, 2014

Related U.S. Application Data

(60) Provisional application No. 61/729,933, filed on Nov. 26, 2012, provisional application No. 61/737,224, filed on Dec. 14, 2012, provisional application No. 61/758,921, filed on Jan. 31, 2013, provisional application No. 61/781,139, filed on Mar. 14, 2013, provisional application No. 61/829,359, filed on May 31, 2013, provisional application No. 61/839,903, filed on Jun. 27, 2013, provisional application No. 61/842,709, filed on Jul. 3, 2013, provisional application No. 61/857,436, filed on Jul. 23, 2013, provisional application No. 61/775,509, filed on Mar. 9, 2013, provisional application No. 61/829,372, filed on May 31, 2013.

(51) Int. Cl.
| | |
|---|---|
| *A61K 39/00* | (2006.01) |
| *A61K 48/00* | (2006.01) |
| *C07H 21/04* | (2006.01) |
| *C12N 15/67* | (2006.01) |

(52) U.S. Cl.
CPC .............. *A61K 39/00* (2013.01); *C12N 15/67* (2013.01)

(58) Field of Classification Search
CPC A61K 31/7115; A61K 39/00; A61K 48/0066; A01K 67/0276; C12N 15/67; C12N 15/86; C12N 15/111
USPC ...................................................... 424/185.1
See application file for complete search history.

(56) References Cited

U.S. PATENT DOCUMENTS

| | | |
|---|---|---|
| 2,008,526 A | 7/1935 | Wrappler et al. |
| 3,552,394 A | 1/1971 | Horn et al. |
| 3,737,524 A | 6/1973 | Ebel et al. |
| 3,766,907 A | 10/1973 | Muenzer |
| 3,906,092 A | 9/1975 | Hilleman et al. |
| 4,373,071 A | 2/1983 | Itakura |
| 4,399,216 A | 8/1983 | Axel et al. |
| 4,401,796 A | 8/1983 | Itakura |
| 4,411,657 A | 10/1983 | Galindo |
| 4,415,732 A | 11/1983 | Caruthers et al. |
| 4,458,066 A | 7/1984 | Caruthers et al. |
| 4,474,569 A | 10/1984 | Newkirk |
| 4,500,707 A | 2/1985 | Caruthers et al. |
| 4,579,849 A | 4/1986 | MacCoss et al. |
| 4,588,585 A | 5/1986 | Mark et al. |
| 4,668,777 A | 5/1987 | Caruthers et al. |
| 4,737,462 A | 4/1988 | Mark et al. |
| 4,816,567 A | 3/1989 | Cabilly et al. |
| 4,879,111 A | 11/1989 | Chong |
| 4,957,735 A | 9/1990 | Huang |
| 4,959,314 A | 9/1990 | Mark et al. |
| 4,973,679 A | 11/1990 | Caruthers et al. |
| 5,012,818 A | 5/1991 | Joishy |
| 5,017,691 A | 5/1991 | Lee et al. |
| 5,021,335 A | 6/1991 | Tecott et al. |
| 5,036,006 A | 7/1991 | Sanford et al. |
| 5,047,524 A | 9/1991 | Andrus et al. |
| 5,116,943 A | 5/1992 | Koths et al. |
| 5,130,238 A | 7/1992 | Malek et al. |
| 5,132,418 A | 7/1992 | Caruthers et al. |
| 5,153,319 A | 10/1992 | Caruthers et al. |
| 5,168,038 A | 12/1992 | Tecott et al. |
| 5,169,766 A | 12/1992 | Schuster et al. |
| 5,194,370 A | 3/1993 | Berninger et al. |
| 5,199,441 A | 4/1993 | Hogle |
| 5,240,855 A | 8/1993 | Tomes |
| 5,240,885 A | 8/1993 | Aitken et al. |
| 5,262,530 A | 11/1993 | Andrus et al. |
| 5,273,525 A | 12/1993 | Hofmann |
| 5,298,422 A | 3/1994 | Schwartz et al. |
| 5,332,671 A | 7/1994 | Ferrara et al. |
| 5,399,491 A | 3/1995 | Kacian et al. |
| 5,409,818 A | 4/1995 | Davey et al. |
| 5,426,180 A | 6/1995 | Kool |
| 5,437,990 A | 8/1995 | Burg et al. |
| 5,457,041 A | 10/1995 | Ginaven et al. |
| 5,466,586 A | 11/1995 | Davey et al. |
| 5,484,401 A | 1/1996 | Rodriguez et al. |

(Continued)

FOREIGN PATENT DOCUMENTS

| | | |
|---|---|---|
| CA | 2376634 | 12/2000 |
| CA | 2473135 | 6/2003 |

(Continued)

OTHER PUBLICATIONS

US 2002/0198163 A1, 12/2002, Felgner et al. (withdrawn)

(Continued)

*Primary Examiner* — Christopher M Babic
*Assistant Examiner* — Kelaginamane T Hiriyanna
(74) *Attorney, Agent, or Firm* — Nelson Mullins Riley & Scarborough LLP; Amy E. Mandragouras, Esq.

(57) ABSTRACT

The invention relates to compositions and methods for the manufacture and optimization of modified mRNA molecules via optimization of their terminal architecture.

13 Claims, 4 Drawing Sheets

(56) References Cited

U.S. PATENT DOCUMENTS

| | | |
|---|---|---|
| 5,514,545 A | 5/1996 | Eberwine |
| 5,527,288 A | 6/1996 | Gross et al. |
| 5,545,522 A | 8/1996 | Van Gelder et al. |
| 5,554,517 A | 9/1996 | Davey et al. |
| 5,580,859 A | 12/1996 | Felgner et al. |
| 5,588,960 A | 12/1996 | Edwards et al. |
| 5,589,466 A | 12/1996 | Felgner et al. |
| 5,663,153 A | 9/1997 | Hutherson et al. |
| 5,665,545 A | 9/1997 | Malek et al. |
| 5,672,491 A | 9/1997 | Khosla et al. |
| 5,674,267 A | 10/1997 | Mir et al. |
| 5,677,124 A | 10/1997 | DuBois et al. |
| 5,679,512 A | 10/1997 | Laney et al. |
| 5,693,622 A | 12/1997 | Wolff et al. |
| 5,693,761 A | 12/1997 | Queen et al. |
| 5,697,901 A | 12/1997 | Eriksson |
| 5,700,642 A | 12/1997 | Monforte et al. |
| 5,702,384 A | 12/1997 | Umeyama et al. |
| 5,703,055 A | 12/1997 | Felgner et al. |
| 5,712,127 A | 1/1998 | Malek et al. |
| 5,716,785 A | 2/1998 | Van Gelder et al. |
| 5,736,137 A | 4/1998 | Anderson et al. |
| 5,756,264 A | 5/1998 | Schwartz et al. |
| 5,759,179 A | 6/1998 | Balbierz |
| 5,766,903 A | 6/1998 | Sarnow et al. |
| 5,773,244 A | 6/1998 | Ares, Jr. et al. |
| 5,776,456 A | 7/1998 | Anderson et al. |
| 5,789,554 A | 8/1998 | Leung et al. |
| 5,807,707 A | 9/1998 | Andrews et al. |
| 5,824,307 A | 10/1998 | Johnson |
| 5,824,497 A | 10/1998 | Andrews et al. |
| 5,840,299 A | 11/1998 | Bendig et al. |
| 5,843,439 A | 12/1998 | Anderson et al. |
| 5,848,996 A | 12/1998 | Eldor |
| 5,849,546 A | 12/1998 | Sousa et al. |
| 5,851,829 A | 12/1998 | Marasco et al. |
| 5,861,501 A | 1/1999 | Benseler et al. |
| 5,869,230 A | 2/1999 | Sukhatme |
| 5,889,136 A | 3/1999 | Scaringe et al. |
| 5,891,636 A | 4/1999 | Van Gelder et al. |
| 5,914,269 A | 6/1999 | Bennett et al. |
| 5,955,310 A | 9/1999 | Widner et al. |
| 5,958,688 A | 9/1999 | Eberwine et al. |
| 5,962,271 A | 10/1999 | Chenchik et al. |
| 5,962,272 A | 10/1999 | Chenchik et al. |
| 5,965,720 A | 10/1999 | Gryaznov et al. |
| 5,965,726 A | 10/1999 | Pavlakis et al. |
| 5,980,887 A | 11/1999 | Isner et al. |
| 5,989,911 A | 11/1999 | Fournier et al. |
| 5,994,511 A | 11/1999 | Lowman et al. |
| 6,004,573 A | 12/1999 | Rathi et al. |
| 6,019,747 A | 2/2000 | McPhee |
| 6,022,715 A | 2/2000 | Merenkova et al. |
| 6,057,494 A | 5/2000 | Koops et al. |
| 6,063,603 A | 5/2000 | Davey et al. |
| 6,074,642 A | 6/2000 | Wang et al. |
| 6,090,382 A | 7/2000 | Salfeld et al. |
| 6,090,591 A | 7/2000 | Burg et al. |
| 6,096,503 A | 8/2000 | Sutcliffe et al. |
| 6,100,024 A | 8/2000 | Hudson et al. |
| 6,124,091 A | 9/2000 | Petryshyn |
| 6,132,419 A | 10/2000 | Hofmann |
| 6,147,055 A | 11/2000 | Hobart et al. |
| 6,177,274 B1 | 1/2001 | Park et al. |
| 6,187,287 B1 | 2/2001 | Leung et al. |
| 6,190,315 B1 | 2/2001 | Kost et al. |
| 6,210,931 B1 | 4/2001 | Feldstein et al. |
| 6,214,804 B1 | 4/2001 | Felgner et al. |
| 6,217,912 B1 | 4/2001 | Park et al. |
| 6,228,640 B1 | 5/2001 | Cezayirli et al. |
| 6,234,990 B1 | 5/2001 | Rowe et al. |
| 6,235,883 B1 | 5/2001 | Jakobovits et al. |
| 6,239,116 B1 | 5/2001 | Krieg et al. |
| 6,251,665 B1 | 6/2001 | Cezayirli et al. |
| 6,255,076 B1 | 7/2001 | Widner et al. |
| 6,258,558 B1 | 7/2001 | Szostak et al. |
| 6,261,584 B1 | 7/2001 | Peery et al. |
| 6,265,387 B1 | 7/2001 | Wolff et al. |
| 6,265,389 B1 | 7/2001 | Burke |
| 6,267,987 B1 | 7/2001 | Park et al. |
| 6,291,170 B1 | 9/2001 | Van Gelder et al. |
| 6,300,484 B1 | 10/2001 | Duhl |
| 6,303,378 B1 | 10/2001 | Bridenbaugh et al. |
| 6,303,573 B1 | 10/2001 | Ruoslahti et al. |
| 6,310,197 B1 | 10/2001 | Rogers |
| 6,322,967 B1 | 11/2001 | Parkin |
| 6,326,174 B1 | 12/2001 | Joyce et al. |
| 6,334,856 B1 | 1/2002 | Allen et al. |
| 6,355,245 B1 | 3/2002 | Evans et al. |
| 6,368,801 B1 | 4/2002 | Faruqi |
| 6,376,248 B1 | 4/2002 | Hawley-Nelson et al. |
| 6,395,253 B2 | 5/2002 | Levy et al. |
| 6,399,061 B1 | 6/2002 | Anderson et al. |
| 6,406,705 B1 | 6/2002 | Davis et al. |
| 6,410,276 B1 | 6/2002 | Burg et al. |
| 6,413,942 B1 | 7/2002 | Felgner et al. |
| 6,433,155 B1 | 8/2002 | Umansky et al. |
| 6,440,096 B1 | 8/2002 | Lastovich et al. |
| 6,455,043 B1 | 9/2002 | Grillo-Lopez |
| 6,491,657 B2 | 12/2002 | Rowe et al. |
| 6,500,419 B1 | 12/2002 | Hone et al. |
| 6,500,919 B1 | 12/2002 | Adema et al. |
| 6,514,948 B1 | 2/2003 | Raz et al. |
| 6,517,869 B1 | 2/2003 | Park et al. |
| 6,520,949 B2 | 2/2003 | St. Germain |
| 6,525,183 B2 | 2/2003 | Vinayak et al. |
| 6,527,216 B2 | 3/2003 | Eagelman et al. |
| 6,528,262 B1 | 3/2003 | Gilad et al. |
| 6,534,312 B1 | 3/2003 | Shiver et al. |
| 6,541,498 B2 | 4/2003 | Chan et al. |
| 6,552,006 B2 | 4/2003 | Raz et al. |
| 6,555,525 B2 | 4/2003 | Burke |
| 6,565,572 B2 | 5/2003 | Chappius |
| 6,572,857 B1 | 6/2003 | Bravo et al. |
| 6,586,524 B2 | 7/2003 | Sagara |
| 6,589,940 B1 | 7/2003 | Raz et al. |
| 6,610,044 B2 | 8/2003 | Mathiesen |
| 6,610,661 B1 | 8/2003 | Carson et al. |
| 6,613,026 B1 | 9/2003 | Palasis et al. |
| 6,617,106 B1 | 9/2003 | Benner |
| 6,623,457 B1 | 9/2003 | Rosenberg |
| 6,652,886 B2 | 11/2003 | Ahn et al. |
| 6,653,468 B1 | 11/2003 | Guzaev et al. |
| 6,664,066 B2 | 12/2003 | Parks |
| 6,670,178 B1 | 12/2003 | Selden et al. |
| 6,676,938 B1 | 1/2004 | Teti et al. |
| 6,696,038 B1 | 2/2004 | Mahato et al. |
| 6,743,211 B1 | 6/2004 | Prausnitz et al. |
| 6,743,823 B1 | 6/2004 | Summar et al. |
| 6,777,187 B2 | 8/2004 | Makarov et al. |
| 6,808,888 B2 | 10/2004 | Zhang et al. |
| 6,818,421 B2 | 11/2004 | Kossmann et al. |
| 6,835,393 B2 | 12/2004 | Hoffman et al. |
| 6,835,827 B2 | 12/2004 | Vinayak et al. |
| 6,849,405 B2 | 2/2005 | Rogers |
| 6,890,319 B1 | 5/2005 | Crocker |
| 6,896,885 B2 | 5/2005 | Hanna |
| 6,900,302 B2 | 5/2005 | Teti et al. |
| 6,902,734 B2 | 6/2005 | Giles-Komar et al. |
| 6,924,365 B1 | 8/2005 | Miller et al. |
| 6,949,245 B1 | 9/2005 | Sliwkowski |
| 6,960,193 B2 | 11/2005 | Rosenberg |
| 6,962,694 B1 | 11/2005 | Soegaard et al. |
| 7,001,890 B1 | 2/2006 | Wagner et al. |
| 7,052,891 B2 | 5/2006 | Leung et al. |
| 7,074,596 B2 | 7/2006 | Darzynkiewicz et al. |
| 7,125,554 B2 | 10/2006 | Forsberg et al. |
| 7,135,010 B2 | 11/2006 | Buckman et al. |
| 7,183,395 B2 | 2/2007 | Mauro |
| 7,195,761 B2 | 3/2007 | Holtzman et al. |
| 7,198,899 B2 | 4/2007 | Schleyer et al. |
| 7,202,226 B2 | 4/2007 | Murray et al. |
| 7,208,478 B2 | 4/2007 | Carson et al. |
| 7,226,439 B2 | 6/2007 | Prausnitz et al. |

(56) References Cited

U.S. PATENT DOCUMENTS

| | | |
|---|---|---|
| 7,226,595 B2 | 6/2007 | Antonsson et al. |
| 7,268,120 B1 | 9/2007 | Horton et al. |
| 7,276,489 B2 | 10/2007 | Agrawal et al. |
| 7,316,925 B2 | 1/2008 | Draghia-Akli et al. |
| 7,320,961 B2 | 1/2008 | Kempf et al. |
| 7,329,741 B2 | 2/2008 | Duhl |
| 7,335,471 B2 | 2/2008 | Guillerez et al. |
| 7,348,004 B2 | 3/2008 | Peters et al. |
| 7,354,742 B2 | 4/2008 | Kamme et al. |
| 7,371,404 B2 | 5/2008 | Panzner et al. |
| 7,374,778 B2 | 5/2008 | Hoffman et al. |
| 7,374,930 B2 | 5/2008 | Oh et al. |
| 7,378,262 B2 | 5/2008 | Sobek et al. |
| 7,384,739 B2 | 6/2008 | Kitabayashi et al. |
| 7,404,956 B2 | 7/2008 | Peters et al. |
| 7,422,739 B2 | 9/2008 | Anderson et al. |
| 7,456,273 B2 | 11/2008 | Mauro |
| 7,476,506 B2 | 1/2009 | Schleyer et al. |
| 7,476,709 B2 | 1/2009 | Moody et al. |
| 7,479,543 B2 | 1/2009 | Tsuchiya et al. |
| 7,498,414 B2 | 3/2009 | Zhu |
| 7,501,486 B2 | 3/2009 | Zhang et al. |
| 7,521,054 B2 | 4/2009 | Pastan et al. |
| 7,547,678 B2 | 6/2009 | Kempf et al. |
| 7,550,264 B2 | 6/2009 | Getts et al. |
| 7,575,572 B2 | 8/2009 | Sweeney |
| 7,579,318 B2 | 8/2009 | Divita et al. |
| 7,615,225 B2 | 11/2009 | Forsberg et al. |
| 7,629,311 B2 | 12/2009 | Tobinick |
| 7,641,901 B2 | 1/2010 | Goldenberg et al. |
| 7,667,033 B2 | 2/2010 | Alvarado |
| 7,682,612 B1 | 3/2010 | White et al. |
| 7,699,852 B2 | 4/2010 | Frankel et al. |
| 7,708,994 B2 | 5/2010 | Benyunes |
| 7,709,452 B2 | 5/2010 | Pitard |
| 7,718,425 B2 | 5/2010 | Reinke et al. |
| 7,737,108 B1 | 6/2010 | Hoffman et al. |
| 7,745,391 B2 | 6/2010 | Mintz et al. |
| 7,763,253 B2 | 7/2010 | Hedlund et al. |
| 7,776,523 B2 | 8/2010 | Garcia et al. |
| 7,794,719 B2 | 9/2010 | Bardroff et al. |
| 7,799,900 B2 | 9/2010 | Adams et al. |
| 7,820,161 B1 | 10/2010 | Curd et al. |
| 7,820,624 B2 | 10/2010 | Hart et al. |
| 7,829,092 B2 | 11/2010 | Lobb et al. |
| 7,846,895 B2 | 12/2010 | Eckert et al. |
| 7,862,820 B2 | 1/2011 | Peters et al. |
| 7,884,184 B2 | 2/2011 | DeGroot et al. |
| 7,906,490 B2 | 3/2011 | Kool |
| 7,943,168 B2 | 5/2011 | Schlesinger et al. |
| 7,943,581 B2 | 5/2011 | Divita et al. |
| 7,964,571 B2 | 6/2011 | Fewell et al. |
| 7,999,087 B2 | 8/2011 | Dellinger et al. |
| 8,003,129 B2 | 8/2011 | Hoffman et al. |
| 8,008,449 B2 | 8/2011 | Korman et al. |
| 8,039,214 B2 | 10/2011 | Dahl et al. |
| 8,048,999 B2 | 11/2011 | Yamanaka et al. |
| 8,057,821 B2 | 11/2011 | Slobodkin et al. |
| 8,058,069 B2 | 11/2011 | Yaworski et al. |
| 8,101,385 B2 | 1/2012 | Cload et al. |
| 8,105,596 B2 | 1/2012 | Goldenberg et al. |
| 8,108,385 B2 | 1/2012 | Kraft et al. |
| 8,137,911 B2 | 3/2012 | Dahl et al. |
| 8,153,768 B2 | 4/2012 | Kunz et al. |
| 8,158,360 B2 | 4/2012 | Heise et al. |
| 8,158,601 B2 | 4/2012 | Chen et al. |
| 8,178,660 B2 | 5/2012 | Weiner et al. |
| 8,183,345 B2 | 5/2012 | Fay et al. |
| 8,183,352 B2 | 5/2012 | Ayyavoo et al. |
| 8,202,983 B2 | 6/2012 | Dellinger et al. |
| 8,217,016 B2 | 7/2012 | Hoerr et al. |
| 8,226,950 B2 | 7/2012 | Lobb et al. |
| 8,242,081 B2 | 8/2012 | Divita et al. |
| 8,242,087 B2 | 8/2012 | Adelfinskaya et al. |
| 8,242,258 B2 | 8/2012 | Dellinger et al. |
| 8,246,958 B2 | 8/2012 | Bendig et al. |
| 8,278,036 B2 | 10/2012 | Kariko et al. |
| 8,304,183 B2 | 11/2012 | Sooknanan |
| 8,304,532 B2 | 11/2012 | Adamo et al. |
| 8,309,706 B2 | 11/2012 | Dellinger et al. |
| 8,329,172 B2 | 12/2012 | Grillo-Lopez et al. |
| 8,329,182 B2 | 12/2012 | Peters et al. |
| 8,329,887 B2 | 12/2012 | Dahl et al. |
| 8,333,799 B2 | 12/2012 | Bales, Jr. et al. |
| 8,344,153 B2 | 1/2013 | Cottrell et al. |
| 8,349,321 B2 | 1/2013 | Burke et al. |
| 8,367,328 B2 | 2/2013 | Asada et al. |
| 8,367,631 B2 | 2/2013 | Pitard |
| 8,383,340 B2 | 2/2013 | Ketterer et al. |
| 8,394,763 B2 | 3/2013 | Forte et al. |
| 8,399,007 B2 | 3/2013 | Taft et al. |
| 8,404,222 B2 | 3/2013 | Harris |
| 8,404,799 B2 | 3/2013 | Podobinski et al. |
| 8,414,927 B2 | 4/2013 | Richard |
| 8,415,325 B2 | 4/2013 | Kiick et al. |
| 8,420,123 B2 | 4/2013 | Troiano et al. |
| 8,420,605 B2 | 4/2013 | Ulijn et al. |
| 8,431,160 B2 | 4/2013 | O'Hagan et al. |
| 8,435,504 B2 | 5/2013 | Kozlowski et al. |
| 8,440,231 B2 | 5/2013 | Smyth et al. |
| 8,440,614 B2 | 5/2013 | Castor |
| 8,444,992 B2 | 5/2013 | Borkowski et al. |
| 8,449,884 B2 | 5/2013 | Rivera et al. |
| 8,449,916 B1 | 5/2013 | Bellaire et al. |
| 8,450,298 B2 | 5/2013 | Mahon et al. |
| 8,454,946 B2 | 6/2013 | Shen |
| 8,454,948 B2 | 6/2013 | Pearlman et al. |
| 8,460,696 B2 | 6/2013 | Slobodkin et al. |
| 8,460,709 B2 | 6/2013 | Ausborn et al. |
| 8,461,132 B2 | 6/2013 | Cohen et al. |
| 8,466,122 B2 | 6/2013 | Heyes et al. |
| 8,470,560 B2 | 6/2013 | Bergmann-Leitner et al. |
| 8,470,771 B2 | 6/2013 | Gao et al. |
| 8,476,234 B2 | 7/2013 | Fima et al. |
| 8,496,945 B2 | 7/2013 | Schlesinger et al. |
| 8,506,928 B2 | 8/2013 | Ferrara et al. |
| 8,506,966 B2 | 8/2013 | Podda et al. |
| 8,512,964 B2 | 8/2013 | Tontonoz et al. |
| 8,518,871 B2 | 8/2013 | Hsu et al. |
| 8,519,110 B2 | 8/2013 | Kowalska et al. |
| 8,529,538 B2 | 9/2013 | Pang et al. |
| 8,529,939 B2 | 9/2013 | Masters et al. |
| 8,530,429 B2 | 9/2013 | Robbins et al. |
| 8,530,625 B2 | 9/2013 | Kaplan et al. |
| 8,535,655 B2 | 9/2013 | O'Shea et al. |
| 8,535,701 B2 | 9/2013 | Peery et al. |
| 8,535,702 B2 | 9/2013 | Richard et al. |
| 8,545,843 B2 | 10/2013 | Curd et al. |
| 8,557,231 B2 | 10/2013 | Langer et al. |
| 8,557,244 B1 | 10/2013 | White et al. |
| 8,562,992 B2 | 10/2013 | Adams et al. |
| 8,563,041 B2 | 10/2013 | Grayson et al. |
| 8,568,784 B2 | 10/2013 | Lillard et al. |
| 8,569,256 B2 | 10/2013 | Heyes et al. |
| 8,580,297 B2 | 11/2013 | Essler et al. |
| 8,603,499 B2 | 12/2013 | Zale et al. |
| 8,603,500 B2 | 12/2013 | Zale et al. |
| 8,603,501 B2 | 12/2013 | Zale et al. |
| 8,603,534 B2 | 12/2013 | Zale et al. |
| 8,603,535 B2 | 12/2013 | Troiano et al. |
| 8,609,142 B2 | 12/2013 | Troiano et al. |
| 8,609,822 B2 | 12/2013 | Elson et al. |
| 8,613,951 B2 | 12/2013 | Zale et al. |
| 8,613,954 B2 | 12/2013 | Zale et al. |
| 8,617,608 B2 | 12/2013 | Zale et al. |
| 8,618,240 B2 | 12/2013 | Podobinski et al. |
| 8,623,367 B2 | 1/2014 | Momm et al. |
| 8,628,801 B2 | 1/2014 | Garreta et al. |
| 8,636,696 B2 | 1/2014 | Ross et al. |
| 8,636,994 B2 | 1/2014 | Bossard et al. |
| 8,637,028 B2 | 1/2014 | Alexis et al. |
| 8,637,083 B2 | 1/2014 | Troiano et al. |
| 8,642,076 B2 | 2/2014 | Manoharan et al. |
| 8,652,487 B2 | 2/2014 | Maldonado |

(56) References Cited

U.S. PATENT DOCUMENTS

| | | |
|---|---|---|
| 8,652,528 B2 | 2/2014 | Troiano et al. |
| 8,658,211 B2 | 2/2014 | Rozema et al. |
| 8,658,733 B2 | 2/2014 | Jorgedal et al. |
| 8,663,599 B1 | 3/2014 | Sung et al. |
| 8,663,692 B1 | 3/2014 | Muller et al. |
| 8,663,700 B2 | 3/2014 | Troiano et al. |
| 8,664,194 B2 | 3/2014 | de Fougerolles et al. |
| 8,668,926 B1 | 3/2014 | Mousa et al. |
| 8,680,069 B2 | 3/2014 | de Fougerolles et al. |
| 8,685,368 B2 | 4/2014 | Reineke |
| 8,685,458 B2 | 4/2014 | Miller et al. |
| 8,691,223 B2 | 4/2014 | Van Den Brink et al. |
| 8,691,750 B2 | 4/2014 | Constien et al. |
| 8,691,785 B2 | 4/2014 | Teng et al. |
| 8,691,963 B2 | 4/2014 | Brahmbhatt et al. |
| 8,691,966 B2 | 4/2014 | Kariko et al. |
| 8,696,637 B2 | 4/2014 | Ross |
| 8,697,098 B2 | 4/2014 | Perumal et al. |
| 8,703,204 B2 | 4/2014 | Bloom et al. |
| 8,709,483 B2 | 4/2014 | Farokhzad et al. |
| 8,710,200 B2 | 4/2014 | Schrum et al. |
| 8,715,677 B2 | 5/2014 | Bartlett et al. |
| 8,715,689 B2 | 5/2014 | Kinney et al. |
| 8,715,694 B2 | 5/2014 | Apt et al. |
| 8,715,736 B2 | 5/2014 | Sachdeva et al. |
| 8,715,741 B2 | 5/2014 | Maitra et al. |
| 8,716,465 B2 | 5/2014 | Rossi et al. |
| 8,722,341 B2 | 5/2014 | Fouchier et al. |
| 8,728,491 B2 | 5/2014 | Sesardic et al. |
| 8,728,527 B2 | 5/2014 | Singh et al. |
| 8,728,772 B2 | 5/2014 | Suzuki et al. |
| 8,734,832 B2 | 5/2014 | O'hagan et al. |
| 8,734,846 B2 | 5/2014 | Ali et al. |
| 8,734,853 B2 | 5/2014 | Sood et al. |
| 8,735,566 B2 | 5/2014 | Brahmbhatt et al. |
| 8,735,570 B2 | 5/2014 | Miller et al. |
| 8,748,089 B2 | 6/2014 | Kariko et al. |
| 8,754,062 B2 | 6/2014 | de Fougerolles et al. |
| 8,802,438 B2 | 8/2014 | Rossi et al. |
| 8,808,982 B2 | 8/2014 | Dahl et al. |
| 8,822,663 B2 | 9/2014 | Schrum et al. |
| 8,835,108 B2 | 9/2014 | Kariko et al. |
| 8,846,348 B2 | 9/2014 | Jendrisak et al. |
| 8,853,179 B2 | 10/2014 | Mauro et al. |
| 8,853,377 B2 | 10/2014 | Guild et al. |
| 8,871,230 B2 | 10/2014 | Rudolph et al. |
| 8,883,506 B2 | 11/2014 | Rossi et al. |
| 8,999,380 B2 | 4/2015 | Bancel et al. |
| 2001/0001066 A1 | 5/2001 | Cezayirli et al. |
| 2001/0005506 A1 | 6/2001 | Cezayirli et al. |
| 2001/0014753 A1 | 8/2001 | Soloveichik et al. |
| 2002/0001842 A1 | 1/2002 | Chapman et al. |
| 2002/0064517 A1 | 5/2002 | Cederholm-Williams |
| 2002/0111471 A1 | 8/2002 | Lo et al. |
| 2002/0123099 A1 | 9/2002 | Weiner et al. |
| 2002/0123723 A1 | 9/2002 | Sorenson et al. |
| 2002/0127592 A1 | 9/2002 | Ichihara et al. |
| 2002/0130430 A1 | 9/2002 | Castor et al. |
| 2002/0132788 A1 | 9/2002 | Lewis et al. |
| 2002/0143204 A1 | 10/2002 | Evain et al. |
| 2003/0026841 A1 | 2/2003 | Trubetskoy et al. |
| 2003/0032615 A1 | 2/2003 | Felgner et al. |
| 2003/0050468 A1 | 3/2003 | Shiver et al. |
| 2003/0073619 A1 | 4/2003 | Mahato et al. |
| 2003/0077604 A1 | 4/2003 | Sun et al. |
| 2003/0082768 A1 | 5/2003 | Baskerville et al. |
| 2003/0083272 A1 | 5/2003 | Wiederholt et al. |
| 2003/0138419 A1 | 7/2003 | Radic et al. |
| 2003/0143743 A1 | 7/2003 | Schuler et al. |
| 2003/0153735 A1 | 8/2003 | Breece et al. |
| 2003/0158133 A1 | 8/2003 | Movsesian |
| 2003/0170273 A1 | 9/2003 | O'Hagan et al. |
| 2003/0171253 A1 | 9/2003 | Ma et al. |
| 2003/0186237 A1 | 10/2003 | Ginsberg et al. |
| 2003/0191303 A1 | 10/2003 | Vinayak et al. |
| 2003/0192068 A1 | 10/2003 | Deboer et al. |
| 2003/0225016 A1 | 12/2003 | Fearon et al. |
| 2004/0005667 A1 | 1/2004 | Ratti et al. |
| 2004/0018525 A1 | 1/2004 | Wirtz et al. |
| 2004/0106567 A1 | 6/2004 | Hagstrom et al. |
| 2004/0110191 A1 | 6/2004 | Winkler et al. |
| 2004/0122216 A1 | 6/2004 | Nielsen et al. |
| 2004/0142474 A1 | 7/2004 | Mahato et al. |
| 2004/0147027 A1 | 7/2004 | Troy et al. |
| 2004/0167090 A1 | 8/2004 | Monahan et al. |
| 2004/0171041 A1 | 9/2004 | Dahl et al. |
| 2004/0171980 A1 | 9/2004 | Mitragotri et al. |
| 2004/0197802 A1 | 10/2004 | Dahl et al. |
| 2004/0202658 A1 | 10/2004 | Benyunes |
| 2004/0209274 A2 | 10/2004 | Daly |
| 2004/0236268 A1 | 11/2004 | Mitragotri et al. |
| 2004/0259081 A1 | 12/2004 | Watzele et al. |
| 2005/0032730 A1* | 2/2005 | Von Der Mulbe et al. .... 514/44 |
| 2005/0037494 A1 | 2/2005 | Hecker et al. |
| 2005/0054026 A1 | 3/2005 | Atsushi et al. |
| 2005/0059624 A1 | 3/2005 | Hoerr et al. |
| 2005/0064596 A1 | 3/2005 | Riemen et al. |
| 2005/0089913 A1 | 4/2005 | Williams |
| 2005/0112141 A1 | 5/2005 | Terman |
| 2005/0130201 A1 | 6/2005 | Deras et al. |
| 2005/0137155 A1 | 6/2005 | McSwiggen et al. |
| 2005/0147618 A1 | 7/2005 | Rivera et al. |
| 2005/0153333 A1 | 7/2005 | Sooknanan |
| 2005/0181016 A1 | 8/2005 | Freyman et al. |
| 2005/0232919 A1 | 10/2005 | Grasso et al. |
| 2005/0250723 A1 | 11/2005 | Hoerr et al. |
| 2006/0008910 A1 | 1/2006 | MacLachlan et al. |
| 2006/0018971 A1 | 1/2006 | Scott et al. |
| 2006/0035226 A1 | 2/2006 | Scheinert et al. |
| 2006/0057111 A1 | 3/2006 | Hedlund et al. |
| 2006/0083780 A1 | 4/2006 | Heyes et al. |
| 2006/0160743 A1 | 7/2006 | Zhang et al. |
| 2006/0172003 A1 | 8/2006 | Meers et al. |
| 2006/0172966 A1 | 8/2006 | Lipford et al. |
| 2006/0188490 A1 | 8/2006 | Hoerr et al. |
| 2006/0204566 A1 | 9/2006 | Smyth-Templeton et al. |
| 2006/0241076 A1 | 10/2006 | Uhlmann et al. |
| 2006/0247195 A1 | 11/2006 | Ray |
| 2006/0265771 A1 | 11/2006 | Lewis et al. |
| 2006/0275747 A1 | 12/2006 | Hardy et al. |
| 2007/0037147 A1 | 2/2007 | Garcia et al. |
| 2007/0037148 A1 | 2/2007 | Fong et al. |
| 2007/0048741 A1 | 3/2007 | Getts et al. |
| 2007/0048776 A1 | 3/2007 | Mauro |
| 2007/0054278 A1 | 3/2007 | Cargill |
| 2007/0072175 A1 | 3/2007 | Cooper et al. |
| 2007/0087437 A1 | 4/2007 | Hu |
| 2007/0105124 A1 | 5/2007 | Getts et al. |
| 2007/0117112 A1 | 5/2007 | Diener et al. |
| 2007/0122882 A1 | 5/2007 | Nakagawa et al. |
| 2007/0141030 A1 | 6/2007 | Yu et al. |
| 2007/0143878 A1 | 6/2007 | Bhat et al. |
| 2007/0178103 A1 | 8/2007 | Fey et al. |
| 2007/0213287 A1 | 9/2007 | Fewell et al. |
| 2007/0224635 A1 | 9/2007 | Bouquin |
| 2007/0252295 A1 | 11/2007 | Panzner et al. |
| 2007/0265220 A1 | 11/2007 | Rossi et al. |
| 2007/0280929 A1 | 12/2007 | Hoerr et al. |
| 2008/0008711 A1 | 1/2008 | Schleyer et al. |
| 2008/0020431 A1 | 1/2008 | Getts et al. |
| 2008/0025944 A1 | 1/2008 | Hoerr et al. |
| 2008/0075698 A1 | 3/2008 | Sawada et al. |
| 2008/0076174 A1 | 3/2008 | Selden et al. |
| 2008/0119645 A1 | 5/2008 | Griffey et al. |
| 2008/0166414 A1 | 7/2008 | Hanes et al. |
| 2008/0166793 A1 | 7/2008 | Beer et al. |
| 2008/0171711 A1 | 7/2008 | Hoerr et al. |
| 2008/0220471 A1 | 9/2008 | Davis et al. |
| 2008/0260706 A1 | 10/2008 | Rabinovich et al. |
| 2008/0261905 A1 | 10/2008 | Herdewijn et al. |
| 2008/0267873 A1 | 10/2008 | Hoerr et al. |
| 2008/0274463 A1 | 11/2008 | Chen et al. |
| 2008/0275468 A1 | 11/2008 | Chuang et al. |
| 2008/0286813 A1 | 11/2008 | George-Hyslop et al. |

(56) References Cited

U.S. PATENT DOCUMENTS

| | | |
|---|---|---|
| 2008/0293143 A1 | 11/2008 | Lin et al. |
| 2009/0042825 A1 | 2/2009 | Matar et al. |
| 2009/0042829 A1 | 2/2009 | Matar et al. |
| 2009/0048167 A1 | 2/2009 | Hillman |
| 2009/0053775 A1 | 2/2009 | Dahl et al. |
| 2009/0093049 A1 | 4/2009 | Mauro |
| 2009/0093433 A1 | 4/2009 | Woolf et al. |
| 2009/0144839 A1 | 6/2009 | Inana et al. |
| 2009/0169550 A1 | 7/2009 | Dummer |
| 2009/0170090 A1 | 7/2009 | Ignatov et al. |
| 2009/0208418 A1 | 8/2009 | Kohler et al. |
| 2009/0208500 A1 | 8/2009 | Joly et al. |
| 2009/0226470 A1 | 9/2009 | Mauro et al. |
| 2009/0227660 A1 | 9/2009 | Oh et al. |
| 2009/0264511 A1 | 10/2009 | de Fougerolles et al. |
| 2009/0281298 A1 | 11/2009 | Manoharan et al. |
| 2009/0286852 A1 | 11/2009 | Kariko et al. |
| 2009/0324584 A1 | 12/2009 | Hoerr et al. |
| 2010/0003337 A1 | 1/2010 | Hanes et al. |
| 2010/0004313 A1 | 1/2010 | Slobodkin et al. |
| 2010/0004315 A1 | 1/2010 | Slobodkin et al. |
| 2010/0009424 A1 | 1/2010 | Forde et al. |
| 2010/0009865 A1 | 1/2010 | Herdewijn et al. |
| 2010/0015232 A1 | 1/2010 | Besenbacher et al. |
| 2010/0021429 A1 | 1/2010 | Brentzel, Jr. et al. |
| 2010/0028943 A1 | 2/2010 | Thomas et al. |
| 2010/0047261 A1 | 2/2010 | Hoerr et al. |
| 2010/0086922 A1 | 4/2010 | Bryant et al. |
| 2010/0120024 A1 | 5/2010 | Cload et al. |
| 2010/0129877 A1 | 5/2010 | Sahin et al. |
| 2010/0137407 A1 | 6/2010 | Abe et al. |
| 2010/0178271 A1 | 7/2010 | Bridger et al. |
| 2010/0189729 A1 | 7/2010 | Hoerr et al. |
| 2010/0196318 A1 | 8/2010 | Lieberburg |
| 2010/0203076 A1 | 8/2010 | Fotin-Mleczek et al. |
| 2010/0215580 A1 | 8/2010 | Hanes et al. |
| 2010/0233141 A1 | 9/2010 | Polach et al. |
| 2010/0239608 A1 | 9/2010 | Von Der Mulbe et al. |
| 2010/0258135 A1 | 10/2010 | Persson |
| 2010/0260817 A1 | 10/2010 | Slobodkin et al. |
| 2010/0261231 A1 | 10/2010 | Kore et al. |
| 2010/0266587 A1 | 10/2010 | McLachlan |
| 2010/0273220 A1 | 10/2010 | Yanik et al. |
| 2010/0285135 A1 | 11/2010 | Wendorf et al. |
| 2010/0291156 A1 | 11/2010 | Barner et al. |
| 2010/0293625 A1 | 11/2010 | Reed |
| 2010/0297750 A1 | 11/2010 | Natsume et al. |
| 2010/0305196 A1 | 12/2010 | Probst et al. |
| 2011/0002934 A1 | 1/2011 | Luqman et al. |
| 2011/0020352 A1 | 1/2011 | Garcia et al. |
| 2011/0045022 A1 | 2/2011 | Tsai |
| 2011/0053829 A1 | 3/2011 | Baumhof et al. |
| 2011/0065103 A1 | 3/2011 | Sahin et al. |
| 2011/0077287 A1 | 3/2011 | Von Der Mulbe et al. |
| 2011/0086904 A1 | 4/2011 | Russell |
| 2011/0091473 A1 | 4/2011 | Golab et al. |
| 2011/0091879 A1 | 4/2011 | Hillebrand et al. |
| 2011/0097716 A1 | 4/2011 | Natt et al. |
| 2011/0112040 A1 | 5/2011 | Liu et al. |
| 2011/0124100 A1 | 5/2011 | Mauro |
| 2011/0143397 A1 | 6/2011 | Kariko et al. |
| 2011/0143436 A1 | 6/2011 | Dahl et al. |
| 2011/0165123 A1 | 7/2011 | Hartmann et al. |
| 2011/0165159 A1 | 7/2011 | Grillo-Lopez et al. |
| 2011/0172126 A1 | 7/2011 | Brust |
| 2011/0182919 A1 | 7/2011 | Peters et al. |
| 2011/0200582 A1 | 8/2011 | Baryza et al. |
| 2011/0218231 A1 | 9/2011 | Fewell et al. |
| 2011/0244026 A1 | 10/2011 | Guild et al. |
| 2011/0245756 A1 | 10/2011 | Arora et al. |
| 2011/0247090 A1 | 10/2011 | Reed |
| 2011/0250225 A1 | 10/2011 | Fotin-Mleczek et al. |
| 2011/0250237 A1 | 10/2011 | O'Hagan |
| 2011/0269950 A1 | 11/2011 | Von Der Mulbe et al. |
| 2011/0274697 A1 | 11/2011 | Thomas et al. |
| 2011/0275793 A1 | 11/2011 | Debart et al. |
| 2011/0287006 A1 | 11/2011 | Friess et al. |
| 2011/0294717 A1 | 12/2011 | Ali et al. |
| 2011/0300205 A1 | 12/2011 | Geall et al. |
| 2011/0311472 A1 | 12/2011 | Hoerr et al. |
| 2012/0009145 A1 | 1/2012 | Slobodkin et al. |
| 2012/0009221 A1 | 1/2012 | Hoerr et al. |
| 2012/0009649 A1 | 1/2012 | Dahl et al. |
| 2012/0015899 A1 | 1/2012 | Lomonossoff et al. |
| 2012/0021043 A1 | 1/2012 | Kramps et al. |
| 2012/0027813 A1 | 2/2012 | Podda et al. |
| 2012/0046346 A1 | 2/2012 | Rossi et al. |
| 2012/0053333 A1 | 3/2012 | Mauro et al. |
| 2012/0060293 A1 | 3/2012 | Stelter et al. |
| 2012/0065252 A1 | 3/2012 | Schrum et al. |
| 2012/0076836 A1 | 3/2012 | Hori et al. |
| 2012/0094906 A1 | 4/2012 | Guyon et al. |
| 2012/0095077 A1 | 4/2012 | Burrows et al. |
| 2012/0114686 A1 | 5/2012 | Schneewind et al. |
| 2012/0121718 A1 | 5/2012 | Lai et al. |
| 2012/0128699 A1 | 5/2012 | Kandimalla et al. |
| 2012/0129759 A1 | 5/2012 | Liu et al. |
| 2012/0156251 A1 | 6/2012 | Brito et al. |
| 2012/0156679 A1 | 6/2012 | Dahl et al. |
| 2012/0171290 A1 | 7/2012 | Coursaget et al. |
| 2012/0177724 A1 | 7/2012 | Irvine et al. |
| 2012/0178702 A1 | 7/2012 | Huang |
| 2012/0189700 A1 | 7/2012 | Aguilar et al. |
| 2012/0195917 A1 | 8/2012 | Sahin et al. |
| 2012/0195936 A1 | 8/2012 | Rudolph et al. |
| 2012/0207840 A1 | 8/2012 | de los Pinos |
| 2012/0213818 A1 | 8/2012 | Hoerr et al. |
| 2012/0219573 A1 | 8/2012 | Baumhof et al. |
| 2012/0225070 A1 | 9/2012 | Smith et al. |
| 2012/0232133 A1 | 9/2012 | Balazs et al. |
| 2012/0237975 A1 | 9/2012 | Schrum et al. |
| 2012/0251618 A1 | 10/2012 | Schrum et al. |
| 2012/0252117 A1 | 10/2012 | Selden et al. |
| 2012/0258046 A1 | 10/2012 | Mutske |
| 2012/0276048 A1 | 11/2012 | Panzara et al. |
| 2012/0282247 A1 | 11/2012 | Schneewind et al. |
| 2012/0282249 A1 | 11/2012 | Fox et al. |
| 2012/0295832 A1 | 11/2012 | Constien et al. |
| 2012/0301955 A1 | 11/2012 | Thomas et al. |
| 2012/0321719 A1 | 12/2012 | McDonnell et al. |
| 2012/0322864 A1 | 12/2012 | Rossi et al. |
| 2012/0322865 A1 | 12/2012 | Rossi et al. |
| 2013/0012426 A1 | 1/2013 | de los Pinos |
| 2013/0012450 A1 | 1/2013 | de los Pinos |
| 2013/0012566 A1 | 1/2013 | De Los Pinos |
| 2013/0017223 A1 | 1/2013 | Hope et al. |
| 2013/0017265 A1 | 1/2013 | Farokhzad et al. |
| 2013/0022538 A1 | 1/2013 | Rossi et al. |
| 2013/0029418 A1 | 1/2013 | Angel et al. |
| 2013/0059360 A1 | 3/2013 | Bossard et al. |
| 2013/0064894 A1 | 3/2013 | Martin et al. |
| 2013/0065942 A1 | 3/2013 | Matar et al. |
| 2013/0071450 A1 | 3/2013 | Copp-Howland |
| 2013/0072670 A1 | 3/2013 | Srivastava et al. |
| 2013/0072709 A1 | 3/2013 | McManus et al. |
| 2013/0084289 A1 | 4/2013 | Curd et al. |
| 2013/0090287 A1 | 4/2013 | Alessi et al. |
| 2013/0090372 A1 | 4/2013 | Budzik et al. |
| 2013/0102034 A1 | 4/2013 | Schrum |
| 2013/0102545 A1 | 4/2013 | Gao et al. |
| 2013/0108629 A1 | 5/2013 | Dumont et al. |
| 2013/0111615 A1 | 5/2013 | Kariko et al. |
| 2013/0115192 A1 | 5/2013 | Ali et al. |
| 2013/0115196 A1 | 5/2013 | Hantash et al. |
| 2013/0115247 A1 | 5/2013 | de los Pinos |
| 2013/0115272 A1 | 5/2013 | de Fougerrolles et al. |
| 2013/0115273 A1 | 5/2013 | Yang et al. |
| 2013/0115274 A1 | 5/2013 | Knopov et al. |
| 2013/0115293 A1 | 5/2013 | Sabnis et al. |
| 2013/0116307 A1 | 5/2013 | Heyes et al. |
| 2013/0116408 A1 | 5/2013 | de los Pinos |
| 2013/0121954 A1 | 5/2013 | Wakefield et al. |
| 2013/0121988 A1 | 5/2013 | Hoerr et al. |
| 2013/0122104 A1 | 5/2013 | Yaworski et al. |

(56) References Cited

U.S. PATENT DOCUMENTS

| | | |
|---|---|---|
| 2013/0123338 A1 | 5/2013 | Heyes et al. |
| 2013/0123351 A1 | 5/2013 | Dewitt |
| 2013/0123481 A1 | 5/2013 | de Fougerolles et al. |
| 2013/0129627 A1 | 5/2013 | Delehanty et al. |
| 2013/0129726 A1 | 5/2013 | Lee et al. |
| 2013/0129785 A1 | 5/2013 | Manoharan et al. |
| 2013/0129794 A1 | 5/2013 | Kleiner et al. |
| 2013/0129830 A1 | 5/2013 | Chen et al. |
| 2013/0130348 A1 | 5/2013 | Gu et al. |
| 2013/0133483 A1 | 5/2013 | Yang et al. |
| 2013/0136746 A1 | 5/2013 | Schneewind |
| 2013/0137644 A1 | 5/2013 | Alluis et al. |
| 2013/0138032 A1 | 5/2013 | Kim et al. |
| 2013/0142818 A1 | 6/2013 | Baumhof et al. |
| 2013/0142868 A1 | 6/2013 | Hoekman et al. |
| 2013/0142876 A1 | 6/2013 | Howard et al. |
| 2013/0149318 A1 | 6/2013 | Reynolds et al. |
| 2013/0149375 A1 | 6/2013 | Geall |
| 2013/0149783 A1 | 6/2013 | Yockman et al. |
| 2013/0150295 A1 | 6/2013 | Jaworowicz |
| 2013/0150625 A1 | 6/2013 | Budzik et al. |
| 2013/0150822 A1 | 6/2013 | Ross |
| 2013/0156721 A1 | 6/2013 | Cheng et al. |
| 2013/0156776 A1 | 6/2013 | Chang et al. |
| 2013/0156845 A1 | 6/2013 | Manoharan et al. |
| 2013/0156849 A1 | 6/2013 | de Fougerolles et al. |
| 2013/0164219 A1 | 6/2013 | Brinkmann et al. |
| 2013/0164343 A1 | 6/2013 | Hanes et al. |
| 2013/0164348 A1 | 6/2013 | Palasis et al. |
| 2013/0164400 A1 | 6/2013 | Knopov et al. |
| 2013/0165499 A1 | 6/2013 | Vaishnaw et al. |
| 2013/0165504 A1 | 6/2013 | Bancel et al. |
| 2013/0165772 A1 | 6/2013 | Traverso et al. |
| 2013/0171138 A1 | 7/2013 | Peters et al. |
| 2013/0171175 A1 | 7/2013 | Pierce et al. |
| 2013/0171183 A1 | 7/2013 | Schneewind |
| 2013/0171241 A1 | 7/2013 | Geall |
| 2013/0171646 A1 | 7/2013 | Park et al. |
| 2013/0172406 A1 | 7/2013 | Zale et al. |
| 2013/0172600 A1 | 7/2013 | Chang et al. |
| 2013/0177499 A1 | 7/2013 | Brahmbhatt et al. |
| 2013/0177523 A1 | 7/2013 | Ghandehari et al. |
| 2013/0177581 A1 | 7/2013 | Mauro et al. |
| 2013/0177587 A1 | 7/2013 | Robinson et al. |
| 2013/0177611 A1 | 7/2013 | Kaplan et al. |
| 2013/0177633 A1 | 7/2013 | Schutt et al. |
| 2013/0177634 A1 | 7/2013 | Schutt et al. |
| 2013/0177635 A1 | 7/2013 | Schutt et al. |
| 2013/0177636 A1 | 7/2013 | Schutt et al. |
| 2013/0177637 A1 | 7/2013 | Schutt et al. |
| 2013/0177638 A1 | 7/2013 | Schutt et al. |
| 2013/0177639 A1 | 7/2013 | Geall et al. |
| 2013/0177640 A1 | 7/2013 | Geall et al. |
| 2013/0178541 A1 | 7/2013 | Stanton et al. |
| 2013/0183244 A1 | 7/2013 | Hanes et al. |
| 2013/0183355 A1 | 7/2013 | Jain et al. |
| 2013/0183372 A1 | 7/2013 | Schutt et al. |
| 2013/0183373 A1 | 7/2013 | Schutt et al. |
| 2013/0183375 A1 | 7/2013 | Schutt et al. |
| 2013/0183718 A1 | 7/2013 | Rohayem et al. |
| 2013/0184207 A1 | 7/2013 | Fares et al. |
| 2013/0184443 A1 | 7/2013 | Bentley et al. |
| 2013/0184453 A1 | 7/2013 | Davis et al. |
| 2013/0189295 A1 | 7/2013 | Aric et al. |
| 2013/0189351 A1 | 7/2013 | Geall |
| 2013/0189741 A1 | 7/2013 | Meis et al. |
| 2013/0195759 A1 | 8/2013 | Mirkin et al. |
| 2013/0195765 A1 | 8/2013 | Gho et al. |
| 2013/0195846 A1 | 8/2013 | Friess et al. |
| 2013/0195898 A1 | 8/2013 | O'Hagan et al. |
| 2013/0195967 A1 | 8/2013 | Guild et al. |
| 2013/0195968 A1 | 8/2013 | Geall et al. |
| 2013/0195969 A1 | 8/2013 | Geall et al. |
| 2013/0197068 A1 | 8/2013 | Kariko et al. |
| 2013/0202595 A1 | 8/2013 | Pierce et al. |
| 2013/0202645 A1 | 8/2013 | Barner et al. |
| 2013/0202684 A1 | 8/2013 | Geall et al. |
| 2013/0203115 A1 | 8/2013 | Schrum et al. |
| 2013/0209454 A1 | 8/2013 | Diskin et al. |
| 2013/0209456 A1 | 8/2013 | Kano et al. |
| 2013/0216561 A1 | 8/2013 | Govindan |
| 2013/0236419 A1 | 9/2013 | Schneewind et al. |
| 2013/0236500 A1 | 9/2013 | Zale et al. |
| 2013/0236533 A1 | 9/2013 | Von Andrian et al. |
| 2013/0236550 A1 | 9/2013 | Ausborn et al. |
| 2013/0236556 A1 | 9/2013 | Lai et al. |
| 2013/0236968 A1 | 9/2013 | Manoharan et al. |
| 2013/0236974 A1 | 9/2013 | de Fougerolles et al. |
| 2013/0237592 A1 | 9/2013 | de Fougerolles et al. |
| 2013/0237593 A1 | 9/2013 | de Fougerolles et al. |
| 2013/0237594 A1 | 9/2013 | de Fougerolles et al. |
| 2013/0243747 A1 | 9/2013 | Fima et al. |
| 2013/0243827 A1 | 9/2013 | Troiano et al. |
| 2013/0243848 A1 | 9/2013 | Lobovkina et al. |
| 2013/0243867 A1 | 9/2013 | Mohapatra et al. |
| 2013/0244278 A1 | 9/2013 | de Fougerolles et al. |
| 2013/0244279 A1 | 9/2013 | de Fougerolles et al. |
| 2013/0244282 A1 | 9/2013 | Schrum et al. |
| 2013/0244972 A1 | 9/2013 | Ben-Shalom et al. |
| 2013/0245091 A1 | 9/2013 | Rozema et al. |
| 2013/0245103 A1 | 9/2013 | de Fougerolles et al. |
| 2013/0245106 A1 | 9/2013 | de Fougerolles et al. |
| 2013/0245107 A1 | 9/2013 | de Fougerolles et al. |
| 2013/0251679 A1 | 9/2013 | Pearlman et al. |
| 2013/0251766 A1 | 9/2013 | Zale et al. |
| 2013/0251816 A1 | 9/2013 | Zale et al. |
| 2013/0251817 A1 | 9/2013 | Zale et al. |
| 2013/0252281 A1 | 9/2013 | de Fougerolles et al. |
| 2013/0259923 A1 | 10/2013 | Bancel et al. |
| 2013/0259924 A1 | 10/2013 | Bancel et al. |
| 2013/0266553 A1 | 10/2013 | Ballance et al. |
| 2013/0266611 A1 | 10/2013 | Rabinovich et al. |
| 2013/0266617 A1 | 10/2013 | Mirosevich et al. |
| 2013/0266640 A1 | 10/2013 | de Fougerolles et al. |
| 2013/0272994 A1 | 10/2013 | Fu et al. |
| 2013/0273039 A1 | 10/2013 | Grillo-Lopez |
| 2013/0273047 A1 | 10/2013 | Rivera et al. |
| 2013/0273081 A1 | 10/2013 | Monaci et al. |
| 2013/0273104 A1 | 10/2013 | Podda et al. |
| 2013/0273109 A1 | 10/2013 | Settembre et al. |
| 2013/0273117 A1 | 10/2013 | Podobinski et al. |
| 2013/0274194 A1 | 10/2013 | Dumont et al. |
| 2013/0274504 A1 | 10/2013 | Colletti et al. |
| 2013/0274523 A1 | 10/2013 | Bawiec, III et al. |
| 2013/0280334 A1 | 10/2013 | Karp et al. |
| 2013/0280339 A1 | 10/2013 | Zale et al. |
| 2013/0281658 A1 | 10/2013 | Rozema et al. |
| 2013/0281671 A1 | 10/2013 | Peters et al. |
| 2013/0287832 A1 | 10/2013 | O'Hagan |
| 2013/0289093 A1 | 10/2013 | Bhat et al. |
| 2013/0295183 A1 | 11/2013 | Troiano et al. |
| 2013/0295191 A1 | 11/2013 | Troiano et al. |
| 2013/0302432 A1 | 11/2013 | Zale et al. |
| 2013/0302433 A1 | 11/2013 | Troiano et al. |
| 2013/0315831 A1 | 11/2013 | Shi et al. |
| 2013/0317079 A1 | 11/2013 | Wakefield et al. |
| 2013/0323179 A1 | 12/2013 | Popov et al. |
| 2013/0323310 A1 | 12/2013 | Smyth et al. |
| 2013/0330401 A1 | 12/2013 | Payne et al. |
| 2013/0338210 A1 | 12/2013 | Manoharan et al. |
| 2013/0344091 A1 | 12/2013 | Berger et al. |
| 2013/0344158 A1 | 12/2013 | Zale et al. |
| 2014/0004593 A1 | 1/2014 | Boldog et al. |
| 2014/0005379 A1 | 1/2014 | Gu |
| 2014/0010861 A1 | 1/2014 | Bancel et al. |
| 2014/0017327 A1 | 1/2014 | Cheng et al. |
| 2014/0017329 A1 | 1/2014 | Mousa |
| 2014/0030292 A1 | 1/2014 | Franti et al. |
| 2014/0030351 A1 | 1/2014 | Zale et al. |
| 2014/0037573 A1 | 2/2014 | Eliasof et al. |
| 2014/0037660 A1 | 2/2014 | Fotin-Mleczek, M. et al. |
| 2014/0037714 A1 | 2/2014 | Quay et al. |
| 2014/0039032 A1 | 2/2014 | Kumboyama et al. |
| 2014/0044772 A1 | 2/2014 | MacLachlan et al. |

(56) References Cited

U.S. PATENT DOCUMENTS

| | | |
|---|---|---|
| 2014/0044791 A1 | 2/2014 | Basilion et al. |
| 2014/0045913 A1 | 2/2014 | Kuboyama et al. |
| 2014/0045950 A1 | 2/2014 | Lacko et al. |
| 2014/0050775 A1 | 2/2014 | Slobodkin et al. |
| 2014/0056867 A1 | 2/2014 | LeBowitz et al. |
| 2014/0056970 A1 | 2/2014 | Panzner et al. |
| 2014/0057109 A1 | 2/2014 | Mechen et al. |
| 2014/0065172 A1 | 3/2014 | Echeverri et al. |
| 2014/0065204 A1 | 3/2014 | Hayes et al. |
| 2014/0065228 A1 | 3/2014 | Yaroworski et al. |
| 2014/0066363 A1 | 3/2014 | Bhunia et al. |
| 2014/0073687 A1* | 3/2014 | Chien et al. ............... 514/44 R |
| 2014/0073715 A1 | 3/2014 | Fonnum et al. |
| 2014/0073738 A1 | 3/2014 | Fonnum et al. |
| 2014/0079774 A1 | 3/2014 | Brinker et al. |
| 2014/0079776 A1 | 3/2014 | Lippard et al. |
| 2014/0080766 A1 | 3/2014 | Pirie et al. |
| 2014/0081012 A1 | 3/2014 | DeSimone et al. |
| 2014/0093575 A1 | 4/2014 | Hammond et al. |
| 2014/0093579 A1 | 4/2014 | Zale et al. |
| 2014/0100178 A1 | 4/2014 | Ansari et al. |
| 2014/0105930 A1 | 4/2014 | Springer |
| 2014/0105964 A1 | 4/2014 | Bancel et al. |
| 2014/0105965 A1 | 4/2014 | Bancel et al. |
| 2014/0105966 A1 | 4/2014 | Bancel et al. |
| 2014/0106260 A1 | 4/2014 | Cargnello et al. |
| 2014/0107189 A1 | 4/2014 | Bancel et al. |
| 2014/0107227 A1 | 4/2014 | Masters et al. |
| 2014/0107229 A1 | 4/2014 | Kormann et al. |
| 2014/0107349 A1 | 4/2014 | Bentley et al. |
| 2014/0107594 A1 | 4/2014 | Guo et al. |
| 2014/0113137 A1 | 4/2014 | Podobinski et al. |
| 2014/0113959 A1 | 4/2014 | Bancel et al. |
| 2014/0113960 A1 | 4/2014 | Bancel et al. |
| 2014/0121263 A1 | 5/2014 | Fitzgerald et al. |
| 2014/0121393 A1 | 5/2014 | Manoharan et al. |
| 2014/0121587 A1 | 5/2014 | Sallberg et al. |
| 2014/0127227 A1 | 5/2014 | Chang |
| 2014/0127301 A1 | 5/2014 | Alexis et al. |
| 2014/0128269 A1 | 5/2014 | Hinz et al. |
| 2014/0128329 A1 | 5/2014 | Gore et al. |
| 2014/0134129 A1 | 5/2014 | Thalhamer et al. |
| 2014/0134201 A1 | 5/2014 | Tureci et al. |
| 2014/0134230 A1 | 5/2014 | Frank et al. |
| 2014/0135380 A1 | 5/2014 | Hadwiger et al. |
| 2014/0135381 A1 | 5/2014 | Hadwiger et al. |
| 2014/0141025 A1 | 5/2014 | Kudirka et al. |
| 2014/0141037 A1 | 5/2014 | Swanson et al. |
| 2014/0141067 A1 | 5/2014 | Bancel et al. |
| 2014/0141068 A1 | 5/2014 | Bancel et al. |
| 2014/0141070 A1 | 5/2014 | Geall et al. |
| 2014/0141089 A1 | 5/2014 | Liang |
| 2014/0141483 A1 | 5/2014 | Bossard et al. |
| 2014/0142165 A1 | 5/2014 | Grayson et al. |
| 2014/0142254 A1 | 5/2014 | Fonnum et al. |
| 2014/0147432 A1 | 5/2014 | Bancel et al. |
| 2014/0147454 A1 | 5/2014 | Chakraborty et al. |
| 2014/0148502 A1 | 5/2014 | Bancel et al. |
| 2014/0148503 A1 | 5/2014 | Giangrande et al. |
| 2014/0155472 A1 | 6/2014 | Bancel et al. |
| 2014/0155473 A1 | 6/2014 | Bancel et al. |
| 2014/0155474 A1 | 6/2014 | Bancel et al. |
| 2014/0155475 A1 | 6/2014 | Bancel et al. |
| 2014/0161873 A1 | 6/2014 | Bancel et al. |
| 2014/0162934 A1 | 6/2014 | Constien et al. |
| 2014/0162962 A1 | 6/2014 | Constien et al. |
| 2014/0170175 A1 | 6/2014 | Constien et al. |
| 2014/0171485 A1 | 6/2014 | Bancel et al. |
| 2014/0178429 A1 | 6/2014 | Tsai |
| 2014/0178438 A1 | 6/2014 | Sahin et al. |
| 2014/0179771 A1 | 6/2014 | Bancel et al. |
| 2014/0186432 A1 | 7/2014 | Bancel et al. |
| 2014/0193482 A1 | 7/2014 | Bancel et al. |
| 2014/0193484 A1 | 7/2014 | Bertholet Girardin et al. |
| 2014/0194494 A1 | 7/2014 | Bancel et al. |
| 2014/0199371 A1 | 7/2014 | Bancel et al. |
| 2014/0200261 A1 | 7/2014 | Hoge et al. |
| 2014/0200262 A1 | 7/2014 | Bancel et al. |
| 2014/0200263 A1 | 7/2014 | Bancel et al. |
| 2014/0200264 A1 | 7/2014 | Bancel et al. |
| 2014/0206752 A1 | 7/2014 | Afeyan et al. |
| 2014/0206753 A1 | 7/2014 | Guild et al. |
| 2014/0206755 A1 | 7/2014 | Bancel et al. |
| 2014/0206852 A1 | 7/2014 | Hoge et al. |
| 2014/0212498 A1 | 7/2014 | Brito et al. |
| 2014/0212504 A1 | 7/2014 | Weers et al. |
| 2014/0220083 A1 | 8/2014 | Brito et al. |
| 2014/0221465 A1 | 8/2014 | Bancel et al. |
| 2014/0227237 A1 | 8/2014 | June et al. |
| 2014/0227300 A1 | 8/2014 | Chin et al. |
| 2014/0227346 A1 | 8/2014 | Geall et al. |
| 2014/0242152 A1 | 8/2014 | Geall et al. |
| 2014/0243399 A1 | 8/2014 | Schrum et al. |
| 2014/0248312 A1 | 9/2014 | Rappuoli et al. |
| 2014/0248314 A1 | 9/2014 | Swanson et al. |
| 2014/0249208 A1 | 9/2014 | Bancel et al. |
| 2014/0255467 A1 | 9/2014 | Bancel et al. |
| 2014/0255468 A1 | 9/2014 | Bancel et al. |
| 2014/0255472 A1 | 9/2014 | Geall et al. |
| 2014/0271829 A1 | 9/2014 | Lilja et al. |
| 2014/0275227 A1 | 9/2014 | Hoge et al. |
| 2014/0275229 A1 | 9/2014 | Bancel et al. |
| 2014/0288160 A1 | 9/2014 | Guild et al. |
| 2014/0294938 A1 | 10/2014 | Guild et al. |
| 2014/0294939 A1 | 10/2014 | Guild et al. |
| 2014/0294940 A1 | 10/2014 | Guild et al. |
| 2014/0308746 A1 | 10/2014 | Rossi et al. |
| 2014/0309277 A1 | 10/2014 | Baryza et al. |
| 2014/0315988 A1 | 10/2014 | Dahl et al. |
| 2014/0328825 A1 | 11/2014 | Meis et al. |
| 2014/0341995 A1 | 11/2014 | Rudolph et al. |
| 2014/0343129 A1 | 11/2014 | de Fougerolles et al. |
| 2014/0363876 A1 | 12/2014 | Jendrisak et al. |
| 2014/0370545 A1 | 12/2014 | Mauro et al. |
| 2014/0371302 A1 | 12/2014 | Afeyan et al. |
| 2014/0378538 A1 | 12/2014 | Bancel et al. |
| 2015/0004217 A1 | 1/2015 | Guild et al. |
| 2015/0005372 A1 | 1/2015 | Hoge et al. |
| 2015/0017206 A1 | 1/2015 | Rueckl et al. |
| 2015/0017211 A1 | 1/2015 | de Fougerolles et al. |
| 2015/0030576 A1 | 1/2015 | Bancel et al. |
| 2015/0038558 A1 | 2/2015 | Kariko et al. |
| 2015/0044277 A1 | 2/2015 | Bancel et al. |
| 2015/0050354 A1 | 2/2015 | Bouchon et al. |
| 2015/0051268 A1 | 2/2015 | Bancel et al. |
| 2015/0056253 A1 | 2/2015 | Bancel et al. |
| 2015/0064235 A1 | 3/2015 | Bancel et al. |
| 2015/0064236 A1 | 3/2015 | Bancel et al. |
| 2015/0064725 A1 | 3/2015 | Schrum et al. |
| 2015/0086614 A1 | 3/2015 | Bancel et al. |
| 2015/0111248 A1 | 4/2015 | Bancel et al. |

FOREIGN PATENT DOCUMENTS

| | | |
|---|---|---|
| CA | 2795695 | 10/2011 |
| EP | 0194809 | 3/1986 |
| EP | 0204401 | 12/1986 |
| EP | 0366400 | 10/1989 |
| EP | 0366400 | 5/1990 |
| EP | 0427073 | 5/1991 |
| EP | 0427074 | 5/1991 |
| EP | 0735144 B1 | 3/1996 |
| EP | 0726319 | 8/1996 |
| EP | 0737750 | 10/1996 |
| EP | 0771873 A3 | 7/1997 |
| EP | 0839912 | 5/1998 |
| EP | 0969862 | 1/2000 |
| EP | 1026253 | 8/2000 |
| EP | 1083232 B1 | 3/2001 |
| EP | 1404860 | 5/2002 |
| EP | 1224943 | 7/2002 |
| EP | 1361277 | 11/2003 |
| EP | 1393745 | 3/2004 |
| EP | 1083232 | 2/2005 |

(56) References Cited

FOREIGN PATENT DOCUMENTS

| | | |
|---|---|---|
| EP | 1301614 | 11/2006 |
| EP | 1873180 A1 | 1/2008 |
| EP | 1905844 A2 | 2/2008 |
| EP | 1964922 A1 | 3/2008 |
| EP | 2072618 | 6/2009 |
| EP | 1056873 | 3/2010 |
| EP | 2191840 | 6/2010 |
| EP | 2092064 | 9/2010 |
| EP | 2246422 | 11/2010 |
| EP | 1619254 | 12/2010 |
| EP | 2292771 | 3/2011 |
| EP | 2377938 | 10/2011 |
| EP | 2468290 A1 | 6/2012 |
| EP | 2476430 B1 | 7/2012 |
| EP | 2484770 | 8/2012 |
| EP | 1907590 | 9/2012 |
| EP | 2535419 | 12/2012 |
| EP | 2188379 | 1/2013 |
| EP | 2548960 | 1/2013 |
| EP | 2620161 | 7/2013 |
| EP | 2623121 | 7/2013 |
| EP | 2073848 | 8/2013 |
| EP | 2623121 | 8/2013 |
| EP | 2695608 A2 | 2/2014 |
| EP | 2160464 B1 | 5/2014 |
| EP | 2607379 B1 | 5/2014 |
| EP | 2732825 A1 | 5/2014 |
| WO | 89/07947 A1 | 3/1989 |
| WO | 8906700 | 7/1989 |
| WO | 8909622 A1 | 10/1989 |
| WO | 9011092 | 10/1990 |
| WO | 9201813 A1 | 2/1992 |
| WO | 92/16553 A1 | 10/1992 |
| WO | 9309236 | 5/1993 |
| WO | 9314778 | 8/1993 |
| WO | 9512665 | 5/1995 |
| WO | 9524485 | 9/1995 |
| WO | 9526204 | 10/1995 |
| WO | 9529697 A1 | 11/1995 |
| WO | 95/35375 A1 | 12/1995 |
| WO | 9533835 | 12/1995 |
| WO | 9617086 | 6/1996 |
| WO | 9711085 | 3/1997 |
| WO | 9712519 | 4/1997 |
| WO | 9730064 A1 | 8/1997 |
| WO | 9741210 | 11/1997 |
| WO | 9746680 | 12/1997 |
| WO | 9748370 | 12/1997 |
| WO | 9800547 | 1/1998 |
| WO | 9812207 | 3/1998 |
| WO | 9819710 A2 | 5/1998 |
| WO | 9834640 | 8/1998 |
| WO | 9847913 A2 | 10/1998 |
| WO | 9855495 | 12/1998 |
| WO | 99/06073 | 2/1999 |
| WO | 9914346 | 3/1999 |
| WO | 9920766 | 4/1999 |
| WO | 9920774 | 4/1999 |
| WO | 9924595 | 5/1999 |
| WO | 9933982 | 7/1999 |
| WO | 9942618 | 8/1999 |
| WO | 9943835 | 9/1999 |
| WO | 9952503 | 10/1999 |
| WO | 9954457 | 10/1999 |
| WO | 0026226 | 5/2000 |
| WO | 0027340 | 5/2000 |
| WO | 0029561 | 5/2000 |
| WO | 0039327 | 7/2000 |
| WO | 0050586 | 8/2000 |
| WO | 0075304 | 12/2000 |
| WO | 0075356 | 12/2000 |
| WO | 0100650 | 1/2001 |
| WO | 0104313 | 1/2001 |
| WO | 01/14424 A2 | 3/2001 |
| WO | 0121810 | 3/2001 |
| WO | 0155306 | 8/2001 |
| WO | 0155369 | 8/2001 |
| WO | 01/78779 A2 | 10/2001 |
| WO | 0192523 | 12/2001 |
| WO | 0193902 | 12/2001 |
| WO | 0208435 | 1/2002 |
| WO | 0224873 | 3/2002 |
| WO | 0246477 | 6/2002 |
| WO | 02064799 | 8/2002 |
| WO | 02065093 | 8/2002 |
| WO | 02102839 | 12/2002 |
| WO | 03002604 | 1/2003 |
| WO | 03018798 | 3/2003 |
| WO | 03028656 | 4/2003 |
| WO | 03046578 | 6/2003 |
| WO | 03050258 | 6/2003 |
| WO | 03051923 | 6/2003 |
| WO | 03059194 | 7/2003 |
| WO | 03059381 | 7/2003 |
| WO | 03066649 | 8/2003 |
| WO | 03086280 | 10/2003 |
| WO | 03087815 | 10/2003 |
| WO | 03101401 | 12/2003 |
| WO | 2004005544 | 1/2004 |
| WO | 2004010106 | 1/2004 |
| WO | 2005017107 A2 | 2/2004 |
| WO | 2004035607 A2 | 4/2004 |
| WO | 2004037972 | 5/2004 |
| WO | 2004058159 | 7/2004 |
| WO | 2004065561 | 8/2004 |
| WO | 2004067728 | 8/2004 |
| WO | 2004085474 | 10/2004 |
| WO | 2004087868 | 10/2004 |
| WO | 2004092329 | 10/2004 |
| WO | 2005005622 | 1/2005 |
| WO | 2005009346 | 2/2005 |
| WO | 2005/044859 A2 | 5/2005 |
| WO | 2005040416 | 5/2005 |
| WO | 2005047536 | 5/2005 |
| WO | 2005/062967 A2 | 7/2005 |
| WO | 2005098433 | 10/2005 |
| WO | 2005103081 A2 | 11/2005 |
| WO | 2005117557 | 12/2005 |
| WO | 2005118857 | 12/2005 |
| WO | 2006008154 A1 | 1/2006 |
| WO | 2006/013107 A1 | 2/2006 |
| WO | 2006022712 | 3/2006 |
| WO | 2006044456 | 4/2006 |
| WO | 2006044503 | 4/2006 |
| WO | 2006044505 | 4/2006 |
| WO | 2006044682 | 4/2006 |
| WO | 2006046978 A2 | 5/2006 |
| WO | 2006058088 | 6/2006 |
| WO | 2006063249 | 6/2006 |
| WO | 2006065479 | 6/2006 |
| WO | 2006065480 | 6/2006 |
| WO | 2006071903 | 7/2006 |
| WO | 2006095259 | 9/2006 |
| WO | 2006110581 | 10/2006 |
| WO | 2006110585 | 10/2006 |
| WO | 2006110599 | 10/2006 |
| WO | 2007/000668 A2 | 1/2007 |
| WO | 2007005645 | 1/2007 |
| WO | 2007024323 | 3/2007 |
| WO | 2007024708 | 3/2007 |
| WO | 2007025008 | 3/2007 |
| WO | 2007064952 | 3/2007 |
| WO | 2007059782 A1 | 5/2007 |
| WO | 2007062495 | 6/2007 |
| WO | 2007067968 | 6/2007 |
| WO | 2007069068 A2 | 6/2007 |
| WO | 2007095976 A2 | 8/2007 |
| WO | 2007100699 | 9/2007 |
| WO | 2007100789 | 9/2007 |
| WO | 2007104537 | 9/2007 |
| WO | 2008/003319 A1 | 1/2008 |
| WO | 2008011519 | 1/2008 |
| WO | 2008/019371 A1 | 2/2008 |
| WO | 2008014979 | 2/2008 |

(56) References Cited

FOREIGN PATENT DOCUMENTS

| | | |
|---|---|---|
| WO | 2008014979 A2 | 2/2008 |
| WO | 2008022046 A2 | 2/2008 |
| WO | 2008042973 | 4/2008 |
| WO | 2008051245 | 5/2008 |
| WO | 2008052770 | 5/2008 |
| WO | 2008068631 | 6/2008 |
| WO | 2008078180 | 7/2008 |
| WO | 2008078180 A2 | 7/2008 |
| WO | 2008083949 | 7/2008 |
| WO | 2008083949 A2 | 7/2008 |
| WO | 2008091799 | 7/2008 |
| WO | 2008/096370 A2 | 8/2008 |
| WO | 2008107388 A1 | 9/2008 |
| WO | 2008115504 A2 | 9/2008 |
| WO | 2008/134724 A2 | 11/2008 |
| WO | 2008/143878 A2 | 11/2008 |
| WO | 2008140615 | 11/2008 |
| WO | 2008144365 | 11/2008 |
| WO | 2008151049 A | 12/2008 |
| WO | 2008151058 | 12/2008 |
| WO | 2008153705 | 12/2008 |
| WO | 2008157688 | 12/2008 |
| WO | 2009006438 | 1/2009 |
| WO | 2009015071 | 1/2009 |
| WO | 2009024599 | 2/2009 |
| WO | 2009030254 | 3/2009 |
| WO | 2009030254 A1 | 3/2009 |
| WO | 2009030481 | 3/2009 |
| WO | 2009042971 | 4/2009 |
| WO | 2009046738 | 4/2009 |
| WO | 2009046739 | 4/2009 |
| WO | 2009046974 | 4/2009 |
| WO | 2009046975 | 4/2009 |
| WO | 2009/068649 A2 | 6/2009 |
| WO | 2009075886 | 6/2009 |
| WO | 2009077134 | 6/2009 |
| WO | 2009095226 | 8/2009 |
| WO | 2009101407 | 8/2009 |
| WO | 2009/113083 A1 | 9/2009 |
| WO | 2009/120927 A2 | 10/2009 |
| WO | 2009127060 | 10/2009 |
| WO | 2009127230 | 10/2009 |
| WO | 2009149253 | 12/2009 |
| WO | 2010009065 | 1/2010 |
| WO | 2010009277 | 1/2010 |
| WO | 2010027903 | 3/2010 |
| WO | 2010033906 | 3/2010 |
| WO | 2010037408 | 4/2010 |
| WO | 2010037539 | 4/2010 |
| WO | 2010042490 | 4/2010 |
| WO | 2010042877 | 4/2010 |
| WO | 2010/055413 A1 | 5/2010 |
| WO | 2010054406 | 5/2010 |
| WO | 2010/068918 A2 | 6/2010 |
| WO | 2010084371 A1 | 7/2010 |
| WO | 2010088537 | 8/2010 |
| WO | 2010088927 | 8/2010 |
| WO | 2010098861 | 9/2010 |
| WO | 2010111290 | 9/2010 |
| WO | 2010120266 | 10/2010 |
| WO | 2010129709 | 11/2010 |
| WO | 2010141135 | 12/2010 |
| WO | 2010144740 | 12/2010 |
| WO | 2011005341 A3 | 1/2011 |
| WO | 2011005799 | 1/2011 |
| WO | 2011012316 A2 | 2/2011 |
| WO | 2011/032633 A1 | 3/2011 |
| WO | 2011026641 | 3/2011 |
| WO | 2011026641 A9 | 3/2011 |
| WO | 2011062965 | 5/2011 |
| WO | 2011/069164 A2 | 6/2011 |
| WO | 2011068810 | 6/2011 |
| WO | 2011069528 | 6/2011 |
| WO | 2011069529 | 6/2011 |
| WO | 2011069586 | 6/2011 |
| WO | 2011069587 | 6/2011 |
| WO | 2011071931 | 6/2011 |
| WO | 2011071936 | 6/2011 |
| WO | 2011076807 | 6/2011 |
| WO | 2011025566 | 7/2011 |
| WO | 2011088309 | 7/2011 |
| WO | 2011120053 | 9/2011 |
| WO | 2011127032 A1 | 10/2011 |
| WO | 2011127255 | 10/2011 |
| WO | 2011127933 A1 | 10/2011 |
| WO | 2011128444 | 10/2011 |
| WO | 2011130624 | 10/2011 |
| WO | 2011130624 A2 | 10/2011 |
| WO | 2011133868 A2 | 10/2011 |
| WO | WO 2011/130624 A2 * | 10/2011 |
| WO | 2011137206 | 11/2011 |
| WO | 2011144358 | 11/2011 |
| WO | 2011161653 | 12/2011 |
| WO | 2012003474 A2 | 1/2012 |
| WO | 2012006359 | 1/2012 |
| WO | 2012006369 | 1/2012 |
| WO | 2012006372 | 1/2012 |
| WO | 2012006376 | 1/2012 |
| WO | 2012006377 | 1/2012 |
| WO | 2012006378 | 1/2012 |
| WO | 2012006380 | 1/2012 |
| WO | 2012009644 | 1/2012 |
| WO | 2012010855 | 1/2012 |
| WO | 2012013326 | 2/2012 |
| WO | 2012019168 | 2/2012 |
| WO | 2012019630 | 2/2012 |
| WO | 2012019780 | 2/2012 |
| WO | 2012023044 | 2/2012 |
| WO | 2012024526 | 2/2012 |
| WO | 2012030683 | 3/2012 |
| WO | 2012030901 | 3/2012 |
| WO | 2012030904 A2 | 3/2012 |
| WO | 2012031043 | 3/2012 |
| WO | 2012031046 | 3/2012 |
| WO | 2012034067 A1 | 3/2012 |
| WO | 2012034077 A2 | 3/2012 |
| WO | 2012045075 | 4/2012 |
| WO | 2012045082 | 4/2012 |
| WO | 2012050975 A2 | 4/2012 |
| WO | 2012064429 | 5/2012 |
| WO | 2012065164 | 5/2012 |
| WO | 2012068295 | 5/2012 |
| WO | 2012068360 | 5/2012 |
| WO | 2012068470 | 5/2012 |
| WO | 2012072269 | 6/2012 |
| WO | 2012075040 | 6/2012 |
| WO | 2012088381 | 6/2012 |
| WO | 2012089225 | 7/2012 |
| WO | 2012089338 | 7/2012 |
| WO | 2012094304 | 7/2012 |
| WO | 2012094574 | 7/2012 |
| WO | 2012099755 | 7/2012 |
| WO | 2012099805 | 7/2012 |
| WO | 2012103985 | 8/2012 |
| WO | 2012110636 A2 | 8/2012 |
| WO | 2012112582 | 8/2012 |
| WO | 2012113413 | 8/2012 |
| WO | 2012113513 | 8/2012 |
| WO | 2012116714 | 9/2012 |
| WO | 2012116715 | 9/2012 |
| WO | 2012116810 | 9/2012 |
| WO | 2012116811 | 9/2012 |
| WO | 2012117377 | 9/2012 |
| WO | 2012122318 | 9/2012 |
| WO | 2012125680 | 9/2012 |
| WO | 2012125812 | 9/2012 |
| WO | 2012125987 | 9/2012 |
| WO | 2012129483 | 9/2012 |
| WO | 2012131594 | 10/2012 |
| WO | 2012135025 | 10/2012 |
| WO | 2012135805 | 10/2012 |
| WO | 2012135805 A2 | 10/2012 |
| WO | 2012138453 A1 | 10/2012 |
| WO | 2012138530 A1 | 10/2012 |

(56) References Cited

FOREIGN PATENT DOCUMENTS

| | | |
|---|---|---|
| WO | 2012142240 | 10/2012 |
| WO | 2012143407 | 10/2012 |
| WO | 2012/149045 A2 | 11/2012 |
| WO | 2012/149252 A2 | 11/2012 |
| WO | 2012/149255 A2 | 11/2012 |
| WO | 2012/149259 A1 | 11/2012 |
| WO | 2012/149265 A2 | 11/2012 |
| WO | 2012/149282 A2 | 11/2012 |
| WO | 2012/149301 A2 | 11/2012 |
| WO | 2012/149376 A2 | 11/2012 |
| WO | 2012/149393 A2 | 11/2012 |
| WO | 2012/152910 A1 | 11/2012 |
| WO | 2012/153297 A1 | 11/2012 |
| WO | 2012/153338 A2 | 11/2012 |
| WO | 2012149246 | 11/2012 |
| WO | 2012149536 A1 | 11/2012 |
| WO | 2012151234 | 11/2012 |
| WO | 2012154202 A1 | 11/2012 |
| WO | 2012158613 | 11/2012 |
| WO | 2012160177 | 11/2012 |
| WO | 2012/162174 A1 | 12/2012 |
| WO | 2012166241 | 12/2012 |
| WO | 2012166923 | 12/2012 |
| WO | 2012168259 | 12/2012 |
| WO | 2012168491 | 12/2012 |
| WO | 2012170607 | 12/2012 |
| WO | 2012170889 | 12/2012 |
| WO | 2012170930 | 12/2012 |
| WO | 2012172495 | 12/2012 |
| WO | 2012172521 | 12/2012 |
| WO | 2012177760 A1 | 12/2012 |
| WO | 2013/003887 A1 | 1/2013 |
| WO | 2013/006824 A2 | 1/2013 |
| WO | 2013003475 | 1/2013 |
| WO | 2013006437 | 1/2013 |
| WO | 2013006825 | 1/2013 |
| WO | 2013006834 | 1/2013 |
| WO | 2013006837 | 1/2013 |
| WO | 2013006838 | 1/2013 |
| WO | 2013006842 | 1/2013 |
| WO | 2013009717 | 1/2013 |
| WO | 2013009736 | 1/2013 |
| WO | 2013011325 | 1/2013 |
| WO | 2013012476 | 1/2013 |
| WO | 2013016460 | 1/2013 |
| WO | 2013019669 | 2/2013 |
| WO | 2013025834 A2 | 2/2013 |
| WO | 2013030778 | 3/2013 |
| WO | 2013032829 | 3/2013 |
| WO | 2013033438 | 3/2013 |
| WO | 2013033563 | 3/2013 |
| WO | 2013033620 | 3/2013 |
| WO | 2013038375 | 3/2013 |
| WO | 2013039857 | 3/2013 |
| WO | 2013039861 | 3/2013 |
| WO | 2013044219 | 3/2013 |
| WO | 2003029401 | 4/2013 |
| WO | 2013045505 | 4/2013 |
| WO | 2013049234 | 4/2013 |
| WO | 2013049247 | 4/2013 |
| WO | 2013049328 | 4/2013 |
| WO | 2013052167 | 4/2013 |
| WO | 2013052523 | 4/2013 |
| WO | 2013054307 | 4/2013 |
| WO | 2013055331 | 4/2013 |
| WO | 2013055905 | 4/2013 |
| WO | 2013055971 | 4/2013 |
| WO | 2013056132 | 4/2013 |
| WO | 2013057687 | 4/2013 |
| WO | 2013057715 | 4/2013 |
| WO | 2013059496 | 4/2013 |
| WO | 2013059509 | 4/2013 |
| WO | 2013/066866 A1 | 5/2013 |
| WO | 2013059922 | 5/2013 |
| WO | 2013061208 | 5/2013 |
| WO | 2013062140 | 5/2013 |
| WO | 2013063468 | 5/2013 |
| WO | 2013063530 | 5/2013 |
| WO | 2013064911 | 5/2013 |
| WO | 2013066274 | 5/2013 |
| WO | 2013066427 | 5/2013 |
| WO | 2013066903 | 5/2013 |
| WO | 2013067355 | 5/2013 |
| WO | 2013067530 | 5/2013 |
| WO | 2013067537 | 5/2013 |
| WO | 2013068413 | 5/2013 |
| WO | 2013068431 | 5/2013 |
| WO | 2013068432 | 5/2013 |
| WO | 2013068847 | 5/2013 |
| WO | 2013070653 | 5/2013 |
| WO | 2013070872 | 5/2013 |
| WO | 2013071047 | 5/2013 |
| WO | 2013072392 | 5/2013 |
| WO | 2013072929 | 5/2013 |
| WO | 2013074696 | 5/2013 |
| WO | 2013075068 | 5/2013 |
| WO | 2013077907 | 5/2013 |
| WO | 2013078199 | 5/2013 |
| WO | 2013/087911 A1 | 6/2013 |
| WO | 2013079604 | 6/2013 |
| WO | 2013082111 | 6/2013 |
| WO | 2013082418 | 6/2013 |
| WO | 2013082427 | 6/2013 |
| WO | 2013082470 | 6/2013 |
| WO | 2013082529 | 6/2013 |
| WO | 2013082590 | 6/2013 |
| WO | 2013084000 | 6/2013 |
| WO | 2013085951 | 6/2013 |
| WO | 2013086008 | 6/2013 |
| WO | 2013086322 | 6/2013 |
| WO | 2013086354 | 6/2013 |
| WO | 2013086373 | 6/2013 |
| WO | 2013086486 | 6/2013 |
| WO | 2013086502 | 6/2013 |
| WO | 2013086505 | 6/2013 |
| WO | 2013086526 | 6/2013 |
| WO | 2013087083 | 6/2013 |
| WO | 2013087791 | 6/2013 |
| WO | 2013087912 A1 | 6/2013 |
| WO | 2013088250 | 6/2013 |
| WO | 2013090294 | 6/2013 |
| WO | 2013090601 | 6/2013 |
| WO | 2013090648 | 6/2013 |
| WO | 2013090841 | 6/2013 |
| WO | 2013090861 | 6/2013 |
| WO | 2013090897 | 6/2013 |
| WO | 2013091001 | 6/2013 |
| WO | 2013093648 | 6/2013 |
| WO | 2013096626 | 6/2013 |
| WO | 2013096812 A1 | 6/2013 |
| WO | 2013098589 | 7/2013 |
| WO | 2013100869 | 7/2013 |
| WO | 2013103842 | 7/2013 |
| WO | 2013109713 | 7/2013 |
| WO | WO2013/103659 | 7/2013 |
| WO | WO2013109713 | 7/2013 |
| WO | 2013112778 | 8/2013 |
| WO | 2013112780 | 8/2013 |
| WO | 2013113326 | 8/2013 |
| WO | 2013113501 | 8/2013 |
| WO | 2013113502 | 8/2013 |
| WO | 2013113736 | 8/2013 |
| WO | 2013120497 | 8/2013 |
| WO | 2013120498 | 8/2013 |
| WO | 2013120499 | 8/2013 |
| WO | 2013120500 | 8/2013 |
| WO | 2013120626 | 8/2013 |
| WO | 2013120627 | 8/2013 |
| WO | 2013120628 | 8/2013 |
| WO | 2013120629 | 8/2013 |
| WO | 2013126776 | 8/2013 |
| WO | WO2013120497 | 8/2013 |
| WO | WO2013120498 | 8/2013 |
| WO | WO2013120499 | 8/2013 |

(56) References Cited

FOREIGN PATENT DOCUMENTS

| | | |
|---|---|---|
| WO | WO2013120500 | 8/2013 |
| WO | WO2013120626 | 8/2013 |
| WO | WO2013120627 | 8/2013 |
| WO | WO2013120628 | 8/2013 |
| WO | WO2013120629 | 8/2013 |
| WO | 2013128027 | 9/2013 |
| WO | 2013129935 | 9/2013 |
| WO | 2013129936 | 9/2013 |
| WO | 2013130161 | 9/2013 |
| WO | 2013130535 | 9/2013 |
| WO | 2013134349 | 9/2013 |
| WO | 2013135359 | 9/2013 |
| WO | 2013136234 | 9/2013 |
| WO | 2013138343 | 9/2013 |
| WO | 2013138346 | 9/2013 |
| WO | 2013142349 A1 | 9/2013 |
| WO | 2013/151666 A2 | 10/2013 |
| WO | 2013143555 | 10/2013 |
| WO | 2013143683 | 10/2013 |
| WO | 2013143698 | 10/2013 |
| WO | 2013143699 | 10/2013 |
| WO | 2013143700 | 10/2013 |
| WO | 2013148186 | 10/2013 |
| WO | 2013148541 | 10/2013 |
| WO | 2013149141 | 10/2013 |
| WO | 2013151650 | 10/2013 |
| WO | 2013151663 A1 | 10/2013 |
| WO | 2013151664 A1 | 10/2013 |
| WO | 2013151665 A2 | 10/2013 |
| WO | 2013151667 A1 | 10/2013 |
| WO | 2013151668 A2 | 10/2013 |
| WO | 2013151669 | 10/2013 |
| WO | 2013151669 A1 | 10/2013 |
| WO | 2013151670 A2 | 10/2013 |
| WO | 2013151671 A1 | 10/2013 |
| WO | 2013151672 | 10/2013 |
| WO | 2013151672 A2 | 10/2013 |
| WO | 2013151736 A2 | 10/2013 |
| WO | 2013151771 | 10/2013 |
| WO | 2013152351 | 10/2013 |
| WO | 2013153550 | 10/2013 |
| WO | 2013154766 | 10/2013 |
| WO | 2013154774 | 10/2013 |
| WO | 2013155487 | 10/2013 |
| WO | 2013155493 | 10/2013 |
| WO | 2013155513 | 10/2013 |
| WO | 2013158127 | 10/2013 |
| WO | 2013158141 | 10/2013 |
| WO | 2013158579 | 10/2013 |
| WO | 2013/177421 A2 | 11/2013 |
| WO | 2013166385 | 11/2013 |
| WO | 2013166498 | 11/2013 |
| WO | 2013173582 A1 | 11/2013 |
| WO | 2013173657 | 11/2013 |
| WO | 2013173693 | 11/2013 |
| WO | 2013174409 | 11/2013 |
| WO | 2013182683 | 12/2013 |
| WO | 2013184945 | 12/2013 |
| WO | 2013185069 | 12/2013 |
| WO | 2013188979 | 12/2013 |
| WO | 2014004436 A2 | 1/2014 |
| WO | 2014012479 A1 | 1/2014 |
| WO | 2014012994 | 1/2014 |
| WO | 2014012996 | 1/2014 |
| WO | 2014014613 | 1/2014 |
| WO | 2014014890 A1 | 1/2014 |
| WO | 2014015334 | 1/2014 |
| WO | 2014015422 | 1/2014 |
| WO | 2014016439 | 1/2014 |
| WO | 2014018675 | 1/2014 |
| WO | 2014024193 | 2/2014 |
| WO | 2014025312 | 2/2014 |
| WO | 2014025795 | 2/2014 |
| WO | 2014025890 | 2/2014 |
| WO | 2014026044 | 2/2014 |
| WO | 2014026284 | 2/2014 |
| WO | 2014027006 | 2/2014 |
| WO | 2014028209 | 2/2014 |
| WO | 2014028429 A2 | 2/2014 |
| WO | 2014028487 | 2/2014 |
| WO | 2014028763 | 2/2014 |
| WO | 2014/039185 A1 | 3/2014 |
| WO | 2014/042920 A1 | 3/2014 |
| WO | 2014/043618 A1 | 3/2014 |
| WO | 2014/047649 A1 | 3/2014 |
| WO | 2014/052634 A1 | 4/2014 |
| WO | 2014/053654 A1 | 4/2014 |
| WO | 2014/054026 A1 | 4/2014 |
| WO | 2014/059022 A1 | 4/2014 |
| WO | 2014053622 A1 | 4/2014 |
| WO | 2014053624 A1 | 4/2014 |
| WO | 2014053628 A1 | 4/2014 |
| WO | 2014053629 A1 | 4/2014 |
| WO | 2014053634 A1 | 4/2014 |
| WO | 2014053879 A1 | 4/2014 |
| WO | 2014053880 A1 | 4/2014 |
| WO | 2014053881 A1 | 4/2014 |
| WO | 2014053882 A1 | 4/2014 |
| WO | 2014062697 A2 | 4/2014 |
| WO | 2014063059 A1 | 4/2014 |
| WO | 2014/064534 A2 | 5/2014 |
| WO | 2014/064543 A1 | 5/2014 |
| WO | 2014/066811 A1 | 5/2014 |
| WO | 2014/066898 A9 | 5/2014 |
| WO | 2014/066912 A1 | 5/2014 |
| WO | 2014/071072 A2 | 5/2014 |
| WO | 2014/072468 A1 | 5/2014 |
| WO | 2014/072747 A1 | 5/2014 |
| WO | 2014/072997 A1 | 5/2014 |
| WO | 2014/072999 A1 | 5/2014 |
| WO | 2014/074218 A1 | 5/2014 |
| WO | 2014/074299 A1 | 5/2014 |
| WO | 2014/074597 A1 | 5/2014 |
| WO | 2014064258 A1 | 5/2014 |
| WO | 2014064687 A1 | 5/2014 |
| WO | 2014067551 A1 | 5/2014 |
| WO | 2014068542 A1 | 5/2014 |
| WO | 2014071219 A1 | 5/2014 |
| WO | 2014071963 A1 | 5/2014 |
| WO | 2014072061 A1 | 5/2014 |
| WO | 2014072481 A1 | 5/2014 |
| WO | 2014074289 A1 | 5/2014 |
| WO | 2014074823 A1 | 5/2014 |
| WO | 2014074905 A1 | 5/2014 |
| WO | 2014074912 A1 | 5/2014 |
| WO | 2014075047 A2 | 5/2014 |
| WO | 2014076709 A1 | 5/2014 |
| WO | 2014078399 A1 | 5/2014 |
| WO | 2014078636 A1 | 5/2014 |
| WO | 2014081299 A1 | 5/2014 |
| WO | 2014081300 A1 | 5/2014 |
| WO | 2014081303 A1 | 5/2014 |
| WO | 2014081507 A1 | 5/2014 |
| WO | 2014081849 A1 | 5/2014 |
| WO | 2014093574 A1 | 6/2014 |
| WO | 2014093924 A1 | 6/2014 |
| WO | 2014144039 A1 | 9/2014 |
| WO | 2014144711 A1 | 9/2014 |
| WO | 2014144767 A1 | 9/2014 |
| WO | 2014152027 A1 | 9/2014 |
| WO | 2014152030 A1 | 9/2014 |
| WO | 2014152031 A1 | 9/2014 |
| WO | 2014152211 A1 | 9/2014 |
| WO | 2014152540 A1 | 9/2014 |
| WO | 2014158795 A1 | 10/2014 |
| WO | 2014159813 A1 | 10/2014 |
| WO | 2014164253 A1 | 10/2014 |
| WO | 2015006747 A2 | 1/2015 |
| WO | 2015034925 A1 | 3/2015 |
| WO | 2015034928 A1 | 3/2015 |
| WO | 2015038892 A1 | 3/2015 |
| WO | 2015048744 A2 | 4/2015 |

(56) References Cited

FOREIGN PATENT DOCUMENTS

| WO | 2015051214 A1 | 4/2015 |
|---|---|---|
| WO | 2015058069 A1 | 4/2015 |
| WO | 2016011306 A2 | 1/2016 |

OTHER PUBLICATIONS

Annoni et al 2009, Blood 114:5152-5161.*
Miotti, S. et al., Characterization of Human Ovarian Carcinoma-Associated Antigens Defined by Novel Monoclonal Antibodies with Tumor-Restricted Specificity, Intl. J. Cancer, 1987, vol. 39, No #, pp. 297-303.
Robak, Tadeusz et al., Current and Emerging Treatments for Chrinic Lymphocytic Leukaemia, Drugs, 2009, vol. 69, No. 17, pp. 2415-2449.
Hutas, Ocrelizumab, a humanized monoclonal antibody against CD20 for inflammatory disorders and B-cell malignancies, Curr Opin Investig Drugs, 2008, vol. 11, No #, pp. 1206-1216. (Abstract Only).
Verma, Sandeep, et.al. , Functional Tuning of Nucleic Acids by Chemical Modifications: Tailored Oligonucleotides as Drugs, Devices, and Diagnodtics, The Japan Chemical Journal Forum and Wiley Periodicals, Inc., 2003, Chem Rec 3, pp. 51-60.
Argininosuccinate synthetase; argininosuccinate synthetase, isoform CRA_b {Homo sapiens} NCBI, Dec. 18, 2006, No Vol., pp. 1-3.
Lee et al., Hepatocyte Gene Therapy in a Large Animal: A Neonatal Bovine Model of Citrullinemia, PNAS, 1999, vol. 96, No #, pp. 3981-3986.
Strausberg et al., National Cancer Institute, Cancer Genome Anatomy Project, Tumor Gene Index, gene accession No. BE136127, 1997 pp. ??.
Lysosomal Acid Lipase (lysosomal acid lipase) cholesteryl ester hydrolase isoform 1 precursor [Homo sapiens]; NCBI, 2010, No vol., pp. 1-3.
Du et al., Lysosomal Acid Lipase Deficiency: Correction of Lipid Storage by Adenovirus-Mediated Gene Transfer in Mice; Human Gene Therapy; vol. 13, No #, pp. 1361-1372.
Gu, Minghao et al., Combinatorial synthesis with high throughput discovery of protein-resistant membrane surfaces, BioMaterials, 2013, vol. 34, No#., pp. 6133-6138.
Glucosylceramidase, glucosylceramidase isoform 1precursor [Homo sapiens]; NCBI, 2010, No Vol., pp. 1-4.
Robbins et al., Retroviral Vectors for Use in Human Gene Therapy for Cancer, Gaucher Disease, and Arthritis; Annals of the New York Academy of Sciences, 2006, vol. 716, No. 1, pp. 72-89.
Bertrand, Edouard et al., The snoRNPs and Related Machines: Ancient Devices That Mediate Maturation of rRNA and Other RNAs, 2004, Chapter 13, pp. 223-257.
Zhao, Xiansi et al., Regulation of Nuclear Receptor Activity by a Pseudouridine Synthase through Posttranscriptional Modification of Steroid Receptor RNA Activator, Molecular Cell, 2004, vol. 15, No #, pp. 549-558.
Zhao, Xinliang, Detection and quantitation of RNA base modifications, RNA, 2004, vol. 10:, pp. 996-1002.
Bosma, Piter Jabik et al., Inherited disorders of bilirubin metabolism, Journal of Hepatology, 2003, vol. 38, No #, pp. 107-117.
Chowdhury, Jayanta R. et al., Bilirubin Mono- and Diglucuronide Formation by Human Liver In Vitro: Assay by High-Pressure Liquid Chromatography, Hepatology, 1981, vol. 1, No. 6, pp. 622-627.
Chowdhury, Jayanta R. et al., Molecular Basis for the Lack of Bilirubin-specific and 3-Methylcholanthrene-inducibleU DP-GlucuronosyltransferaseActivities in Gunn Rats, Thej Ournaofl B Iological Chemistry, 1991, vol. 266, No. 27, pp. 18294-18298.
Chowdhury, Namita et al., Isolation of Multiple Normal and Functionally Defective Forms of Uridine Diphosphate-Glucuronosyltransferase from Inbred Gunn Rats, J. Clin. Invest, 1987, vol. 79, No. #, pp. 327-334.
Crigler, John et al. Society Transactions, Society for Pediatric Research, 31st Annual Meeting, Atlantic City, Congenital Familial Nonhemolytic Jaundice with Kernicterus: A New Clinical Entity, 1951, 3rd session, no vol. pp. 1-3.
Miyagi, Shogo J. et al., The Development of UDP-Glucuronosyltransferases 1A1 and 1A6 in the Pediatric Liver, Drug Metabolism and Disposition, 2011, vol. 39, No. 5, pp. 912-919.
Gunn, Charles, Hereditary Acholuric Jaundice in the Rat, Can M.J., 1944, vol. 50, No #, pp. 230-237.
Brockton, NT et al, UGT1A1 polymorphisms and colorectal cancer susceptibility, Cancer, Gut, 2002; vol. 50, pp. 747-748.
Iyanagi, Takashi et al., Molecular Basis of Multiple UDP-Glucuronosyltransferase Isoenzyme Deficiencies in the Hyperbilirubinemic Rat (Gunn Rat), 1991, vol. 266, No. 35, pp. 24048-24052.
Kadakol, Ajit et al., Genetic Lesions of Bilirubin Uridine-diphosphoglucuronate Glucuronosyltransferase (UGT1A1) Causing Crigler-Najjar and Gilbert Syndromes: Correlation of Genotype to Phenotype, Human Mutation, 2000, vol. 16, No #, pp. 297-306.
Miranda, Paula S. Montenegro et al., Towards Liver-Directed Gene Therapy for Crigler-Najjar Syndrome, Current Gene Therapy, 2009, vol. 9, pp. 72-82.
Pastore, Nunzia et al., Sustained Reduction of Hyperbilirubinemia in Gunn Rats After Adeno-Associated Virus-Mediated Gene Transfer of Bilirubin UDP-Glucuronosyltransferase Isozyme 1A1 to Skeletal Muscle, Human Gene Therapy, 2012, vol. 23, No #, pp. 1082-1089.
Schmitt, Françoise et al., Lentiviral Vectors That Express UGT1A1 in Liver and Contain miR-142 Target Sequences Normalize Hyperbilirubinemia in Gunn Rats, Gastroenterology, 201, vol. 139, No #,pp. 999-1007.
Strassburg, Christian P. et al., Hyperbilirubinemia syndromes (Gilbert-Meulengracht, Crigler-Najjar, Dubin-Johnson, and Rotor syndrome), Best Practice & Research Clinical Gastroenterology, 2010, vol. 24, No. #, pp. 555-571.
Sugatani, Junko et al., Transcriptional Regulation of Human UGT1A1 Gene Expression: Activated Glucocorticoid Receptor Enhances constitutive Androstane Receptor/ Pregnane X Receptor-Mediated UDP-Glucuronosyltransferase 1A1 Regulation with Glucocorticoid Receptor-Interacting Protein 1, Molecular Pharmacology, 2013, vol. 67, No. 3, pp. 845-855.
Batshaw, Mark L. et al., Treatment of Inborn Errors of Urea Synthesis, The New England Journal of Medicine, 1982, vol. 306, No. 23, pp. 1387-1392.
Batshaw, Mark L. et al., Risk of Serious Illness in Heterozygotes for Ornithine Transcarbamylase Deficiency, J. Pediatr, 1986, vol. 108, No. 2, pp. 236-241.
Braissant, Olivier et al., Current concepts in the pathogenesis of urea cycle disorders, Molecular Genetics and Metabolism, 2010, vol. 100, pp. S3-S12.
Hodges, Peter E. et al., The spf h mouse: A missense mutation in the ornithine transcarbamylase gene also causes aberrant mRNA splicing, Genetics, Proc. Natl. Acad. Sci. USA, 1989,vol. 86, pp. 4142-4146.
Marini, Juan C et al., Phenylbutyrate improves nitrogen disposal via an alternative pathway without eliciting an increase in protein breakdown and catabolism in control and ornithine transcarbamylase-deficient patients, Am J Clin Nutr , 2011, vol. 93, No. #, pp. 1248-1254.
Rosenberg, Leon E., et al., Biogenesis of Ornithine Transcarbamylase in sprsh Mutant Mice: Two Cytoplasmic Precursors, One Mitochondrial Enzyme, Science,1983, vol. 222, No vol. #, pp. 426-428.
Summar, MD, Marshall et al., Current strategies for the management of neonatal urea cycle disorders, The Journal of Pediatrics, 2001, vol. 138, No. 1, pp. s30-s39.
Walker, V., Ammonia toxicity and its prevention in inherited defects of the urea cycle, Diabetes, Obesity and Metabolism, 2009, vol. 11, No #, pp. 823-835.
Whitington, P. F. et al., Liver transplantation for the treatment of urea cycle disorders, J. Inher. Metab. Dis., 1998, vol. 21 (Suppl 1) pp. 112-118.
Wilcken, Bridget et al., Problems in the management of urea cycle disorders, Molecular Genetics and Metabolism, 2004, vol. 81, No #, S86-S91.

(56) References Cited

OTHER PUBLICATIONS

Cosman, David et al., ULBPs, Novel MHC Class I-Related Molecules, Bind to CMV Glycoprotein UL16 and Stimulate NK Cytotoxicity through the NKG2D Receptor, Immunity,2001, vol. 14, No vol. pp. 123-133.
Croft, Michael et al., TNF superfamily in inflammatory disease: translating basic insights, Trends Immunol, 2012; vol. 33, No. 3, pp. 144-152.
Friese, Manuel A. et al., MICA/NKG2D-Mediated Immunogene Therapy of Experimental Gliomas, Cancer Res, 2003, vol. 63, pp. 8996-9006.
Gomes, Anita Q. et al., Non-classical major histocompatibility complex proteins as determinants of tumour immunosurveillance, 2007, EMBO reports, vol. 8, No. 11, pp. 1024-1030.
Guo, Z Sheng et al., Life after death: targeting high mobility group box 1 in emergent cancer therapies, Am J Cancer Res, 2013;vol. 3, No. 1 pp. 1-20.
Kane, Lawrence P. et al., TIM Proteins and Immunity, J Immunol., 2010; vol. 184, No. (6): 2743-2749.
Lanca, Telma et al., The MHC class Ib protein ULBP1 is a nonredundant determinant of leukemia/lymphoma susceptibility to gd T-cell cytotoxicity, Blood, 2010, vol. 115, No #, pp. 2407-2411.
Lee, Sylvia et al., Cytokines in Cancer Immunotherapy , Cancers, 2011, vol. 3, No. #, pp. 3856-3893.
Lee, Judong et al., TIM Polymorphisms—Genetics and Function, Genes Immun. 2011, vol. 12, No. 8, pp. 595-604.
Raghavan, Malini et al., Calreticulin in the immune system: ins and outs, Cell Press, Trends in Immunology, 2013, vol. 34, No. 1, pp. 13-21.
Shin, Jae Hun et al., Positive conversion of negative signaling of CTLA4 potentiates anti-tumor efficacy of adoptive T cell therapy in murine tumor models, Blood, 2012, No vol. , pp. 1-29.
Sutherland, Claire L. et al., ULBPs, human ligands of the NKG2D receptor, stimulate tumor immunity with enhancement by IL-15, 2006, vol. 108, No #, pp. 1313-1319.
Wang, Haichao et al., HMG-1 as a Late Mediator of Endotoxin Lethality in Mice, Science, 1999, vol. 285, No. 284, pp. 248-251.
Bikard, David et al., Programmable repression and activation of bacterial gene expression using an engineered CRISPR-Cas system, Nucleic Acids Research Advance, 2013, No vol. #, pp. 1-9.
Le Cong et al., Multiplex Genome Engineering Using CRISPR/Cas Systems, Science, 2013, vol. 339, No. 819, pp. 819-823.
Ornithine Carbamoyltransferase; ornithine carbamoyltransferase, mitochondrial precursor [*Homo sapiens*}; NCBI, 2010, No vol., pp. 1-3.
Kiwaki et al., Correction of Ornithine Transcarbamylase Deficiency in Adult spfash Mice and in OTC-Deficient Human Hepatocytes with Recombinany Adenoviruses Bearing the CAG Promoter; Human Gene Therapy, 1996, vol. 7, No #, pp. 821-830.
Hwang, Woong Y et al., Efficient genome editing in zebrafish using a CRISPR-Cas system, Nature Biotechnology, 2013, No vol. pages 1-3.
International Search Report, PCT/US2013/75177, dated May 5, 2014, pp. 1-20.
Robbins, Majorie et al., 2'-O-methyl-modified RNAs Act as TLR7 Antagonists, Molecular Therapy, 2007, vol. 15, No. 9, pp. 1663-1669.
Kandimalla, Ekambar R. et al.Design, synthesis and biological evaluation of novel antagonist compounds of Toll-like receptors 7, 8 and 9, Nucleic Acids Research, 2013, vol. 41, No. 6, pp. 3947-3961.
Hochreiter-Hufford, Amelia et al., and Digestion Clearing the Dead: Apoptotic Cell Sensing, Recognition, Engulfment, Cold Spring Harb Perspect Biol, 2013, No vol. #, pp. 1-20.
Kim, Sunjung et al, Transcriptional Suppression of Interleukin-12 Gene Expression following Phagocytosis of Apoptotic Cells, Immunity, 2004, vol. 21, No #, pp. 643-653.
Broz, Petr et al., Newly described pattern recognition receptors team up against intracellular pathogens, Nature Reviews, Immunology, 2013, vol. 13, No. #, pp. 551-565.

Bonham, Kevin S. et al., A Promiscuous Lipid-Binding Protein Diversifies the Subcellular Sites of Toll-like Receptor Signal Transduction, Cell, 2014, vol. 156, No #, pp. 705-716.
Ravichandran, Kodi S., Find-me and eat-me signals in apoptotic cell clearance: progress and conundrums, JEM, 2010, vol. 207, pp. 1807-1817.
Stuart, Lynda M. et al., Cell Maturation upon Endotoxin-Driven Myeloid Dendritic Inhibitory Effects of Apoptotic Cell Ingestion, The Journal of Immunology, 2002, vol. 168, No #, pp. 1627-1635.
Wallet, Mark A et al., Immunoregulation of Dendritic Cells, Clinical Medicine & Research, 2005, Vo. 3, No. 3, pp. 166-175.
Williams, Charlotte A. et al, Apoptotic cells induce dendritic cell-mediated suppression via interferon-c-induced IDO, Immunology, 2007, vol. 124, No #, pp. 89-101.
Keegan, Liam P. et al., The Many Roles of an RNA Editor, Nature Reviews, Genetics, 2001, vol. 2, No #, pp. 869-878.
Felden, Brice et al., Presence and location of modified nucleotides in *Escherichia colit* mRNA: structural mimicry with tRNA acceptor branches, The EMBO Journal, 1998, vol. 17 No. 11 pp. 3188-3196.
Doffek, Kara et al., Phosphatidyserine Inhibits NFkB and p38 MAPK Activation in Human Monocyte Derived Dendritic Cells, Molecular Immunology, 2011, vol. 48, No. #, pp. 1771-1777.
Oberg (Aquaporins, Production Optimization and Characterization; Thesis for the Degree of Doctor of Philosophy in Natural Science; University of Gothenburg, Department of Chemistry—Biochemistry; pp. 1-69, published May 27, 2011. No vol.
By hAQP5 (*Homo sapiens* aquaporin 5 (AQP5) mRNA; NCBI, pp. 1-5, published Dec. 27, 2010, No vol.
Iduronate 2-Sulfatase: iduronate 2-sulfatase isofirm a preproprotien [*Homo sapiens*], NCBI, 2010, No vol., pp. 1-4.
European Supplementary Search Report, EP11815407, Jun. 13, 2014, pp. 1-13.
Bermudez et al., Treatment with Recombinant Granulocyte Colony-stimulating Factor (Filgrastin) Stimulates Neutrophils and Tissue /macrophages and Induces an Effective non-specific Response Against *Mycobacterium avium* in Mice, Immunology,1998, vol. 94, No. 3, pp. 297-303.
Sheridan, W. et al., Effects of Peripheral-Blood Progenitor Cells Mobilised by Filgrastim (G-CSF) on Platelet Recovery After High-Dose Chemotherapy, The Lancet, 1992, vol. 339, pp. 640-644.
Alpha Galactosidase A; alpha-galactosidase A precursor [ *Homo sapiens*] NCBI, 2010, pp. 1-4.
Ziegler et al., AAV2 Vector Harboring a Liver-Restricted Promoter Facilates Sustained Expression of Therapeutic Levels of a-Galactosidase A and the Induction of Immune Tolerance in Fabry Mice, Molecular Therapy, 2004, vol. 9, No. 2, pp. 231-240.
International Search Report from International Application No. PCT/US2012/068714, dated Aug. 6, 2013.
Iduronate 2-Sulfatase; iduronate 2-sulfatase isofrom a preproprotein [ *Homo sapiens*]; NCBI, 2010, pp. 1-4.
Braun et al., Preclinical Studies of Lymphocyte Gene Therapy for Mild Hunter Syndrome (Mucopolysaccharidosis Type II); Human Gene Therapy, 1996, vol. , No #, pp. 283-290.
Desmond Padhi et al., Single-Dose, Placebo-Controlled, Randomized Study of AMG 785, a Sclerostin Monoclonal Antibody, Journal of Bone and Mineral Research, vol. 26, No. 1, 2011, pp. 19-26.
Yu, Alice et al, Anti-GD2 Antibody with GM-CSF, Interleukin-2, and Isotretinoin for Neuroblastoma,The New England Journal of Medicine, 2010, vol. 363; No. 14, pp. 1324-1334.
Carboxypeptidas N, Carboxypeptidas N caralytic Chanin precursor [*Homo sapiens*] NCBI, 2010, pp. 1-4.
Fan, Xinhao Cynthia, et al., Overexpression of HuR, a nuclear-cytoplasmic shuttling protein, increases the in vivo stability of ARE-containing mRNAs. The EMBO Journal, vol. 17, No. 12, pp. 3448-3460, 1998.
Leppek, Kathrin, Roquin Promotes Constitute mRNA Decay via a Conserved Class of Stem-Loop Recognition Motifs. Cell 153, 869-881, May 9, 2013.
Meijer, H.A., et al. Translational Repression and elF4A2 Activity are Critical for MicroRNA-Mediated Gene Regulation. Science 340, 82-85, Apr. 5, 2013.

(56) References Cited

OTHER PUBLICATIONS

Wellensiek, Brian P., et al. Genome-wide profiling of human cap-independent translation-enhancing elements, Nature Methods, Jun. 16, 2013, pp. 1-6.

Wellensiek, Brian P., et al. Supplementary Information for Genome-wide Profiling of Human Cap-Independent Translation Enhancing Elements, Nature Methods, pp. 1-30.

Kedde, Martijn, et al., A Pumilio-induced RNA structure switch in p27-3' UTR controls miR-221 and miR-222 accessibility, Nature Cell Biology, Sep. 5, 2010, pp. 1-19.

Panek, Josef, et al. An evolutionary conserved pattern of 18S rRNA sequence complementarity to mRNA 5' UTRs and its implications for eukaryotic gene translation regulation, Nucleic Acids Research, 2013, pp. 1-10.

Chappell, Stephen A., et al. Biochemical and functional analysis of a 9-nt RNA sequence that affects translation efficiency in eukaryotic cells, PNAS, Jun. 29, 2004, vol. 101, No. 26, pp. 9590-9594.

Zhou, Wei, et al. A positive feedback vector for identification of nucleotide sequences that enhance translation, PNAS, May 3, 2005, vol. 102, No. 18, pp. 6273-6278.

Matsuda, Daiki, et al. Determinants of Initiation Codon Selection during Translation in Mammalian Cells, PLos ONE, Nov. 2010, vol. 5, Issue 11, pp. 1-13.

Ray, Debashish, et al. A compendium of RNA-binding motifs for decoding gene regulaton, Nature, vol. 499, Jul. 11, 2013, pp. 172-177.

Wilusz, Jeremy E., et al. 3' end processing of a long nuclear-retained non-coding RNA yields a tRNA-like cytoplasmic RNA, Cell, Nov. 28, 2008, 135(5) pp. 919-932.

Peart, Natoya, et al., Non-mRNA 3' end formation: how the other half lives, WIREs RNA 2013, doi: 10.1002/wma.1174, pp. 1-16.

Kore, Anilkumar R., et al. Synthesis and biological validation of $N^7$-(4-chlorophenoxyethyl) substituted dinucleotide cap analogs for mRNA translation. Bioorganic & Medicinal Chemistry 21 (2013), pp. 4570-4574.

Bolukbasi, Mehmet Fatih, et al. miR-1289 and "Zipcode"-like Sequence Enrich mRNAs in Microvesicles. Molecular Therapy-Nucleic Acids (2012) 1, e10: doi:10.1038/mtna.2011.2, pp. 1-10.

International Search Report and Written Opinion from International Application Serial No. PCT/US2011/54636 dated Apr. 17, 2013.

International Search Report for related application PCT/US2011/46861, Apr. 13, 2012.

International Preliminary Report on Patentability for related application PCT/US2012/031781, Oct. 1, 2013.

International Search Report and Written Opinion from International Application Serial No. PCT/US13/062943 dated Jan. 7, 2014.

Anderson, B.R., et al., Incorporation of pseudouridine into mRNA enhances translation by diminishing PKR activation, Nucleic Acids Res. vol. 38, No. 17, Sep. 1, 2010, pp. 5884-5892.

Kariko, K. et al., Generating the optimal mRNA for therapy: HPLC purification eliminates immune activation and improves translation of nucleoside-modified, protien-encoding mRNA. Nucleic Acids Res. vol. 39, No. 21, Nov. 1, 2011, pp. e142-1, XP002696190.

International Search Report and Written Opinion from International Application Serial No. PCT/US13/030067 dated Dec. 20, 2013.

International Search Report and Written Opinion from International Application Serial No. PCT/US13/030070 dated Dec. 23, 2013.

Love et al., Lipid-like materials for low-dose, in vivo gene silencing, PNAS vol. 107 No. 5, pp. 1864-1869, Feb. 2, 2010.

Mockey et al., mRNA-based cancer vaccine: prevention of B16 melanoma progression and metastasis by systemic injection of MART1 mRNA histidylated lipopolyplexes, Cancer Gene Therapy, 2007, 14, pp. 802-814.

Kwon et al. Molecular Basis for LDL receptor recognition by PCSK9. PNAS. 2008 105(6), 1820-1825.

Bates et al., Detection of Familial Hypercholesterolaemia: A Major Treatment Gap in Preventative Cardiology, Heart, Lung and Circulation 2008;17:411-413.

Garber et al.; A sensitive and convenient method for lipoprotein profile analysis of individual mouse plasma samples. Journal of Lipid Research. 2000. 14: 1020-1026.

Goldstein et al., History of Discovery: The LDL Receptor, Arterioscler Thromb Vasc Biol. Apr. 2009 ; 29(4): 431-438.

Hovingh et al., Diagnosis and treatment of familial hypercholesterolaemia, European Heart Journal (2013) 34, 962-971.

Kobayashi et al., Roles of the WHHL Rabbit in Translational Research on Hypercholesterolemia and Cardiovascular Diseases, Journal of Biomedicine and Biotechnology, vol. 2011, Article ID 406473, pp. 1-10.

Lambert et al., Thematic Review Series: New Lipid and Lipoprotein Targets for the Treatment of Cardiometabolic Diseases the PCSK9 decade, Journal of Lipid Research vol. 53, 2012 pp. 2515-2524.

Lipari et al., Furin-cleaved Proprotein Convertase Subtilisin/Kexin Type 9 (PCSK9) is Active and Modulates Low Density Lipoprotein Receptor and Serum Cholesterol Levels. J Biol Chem. 2012, 287(52): 43482-43491.

Surdo et al., Mechanistic implications for LDLreceptor degradation from the PCSK9/LDLR structure at neutral pH, European Molecular Biology Organization, vol. 12 | No. 12 | 2011, pp. 1300-130.

McNutt et al., Antagonism of Secreted PCSK9 Increases Low Density Lipoprotein Receptor Expression in HepG2 Cells. J Biol Chem. 2009. 284(16): 10561-10570.

Ni et al., A PCSK9-binding antibody that structurally mimics the EGF(A) domain of LDL-receptor reduces LDL cholesterol in vivo, Journal of Lipid Research vol. 52, 2011.

Rader et al., Monogenic hypercholesterolemia: new insights in pathogenesis and treatment, J. Clin. Invest. 111:1795-1803 (2003).

Stein et al., Effect of a Monoclonal Antibody to PCSK9 on LDL Cholesterol, N Engl J Med 2012;366:1108-18.

Watts et al., Familial hypercholesterolemia: a missed opportunity in preventive medicine, Nature Clinical Practice, Cardiovascular Medicine, Aug. 2007 , vol. 4, No. 8, pp. 404-405.

Zhang et al., Binding of Proprotein Convertase Subtilisin/Kexin Type 9 to Epidermal Growth Factor-like Repeat A of Low Density Lipoprotein Receptor Decreases Receptor Recycling and Increases Degradation, The Journal of Biological Chemistry, vol. 282, No. 25, pp. 18602-18612, Jun. 22, 2007.

Penheiter et al., Type II Transforming Growth Factor-β Receptor Recycling is Dependent upon the Clathrin Adaptor Protein Dab2, Molecular Biology of the Cell, vol. 21, 4009-4019, Nov. 15, 2010.

Mulkearns et al., FCHO2 organizes clathrin-coated structures and interacts with Dab2 for LDLR endocytosis, Molecular Biology of the Cell, 2012, pp. 1-28.

Teckchandani et al., The clathrin adaptor Dab2 recruits EH domain scaffold proteins to regulate integrin β1 endocytosis, Molecular Biology of the Cell, 2012, pp. 1-28.

Stockinger et al. The PX-domain protein SNX17 interacts with members of the LDL receptor family and modulates endocytosis of the LDL receptor, European Molecular Biology Organization, vol. 21 No. 16 pp. 4259-4267.

Song et al., A putative role of micro RNA in regulation of cholesterol 7α-hydroxylase expression in human hepatocytes, Nature Biotechnol. 2005, 23:709-717.

Beigneux et al., Human CYP7A1 deficiency: progress and enigmas; The Journal of Clinical Investigation; Jul. 2002, vol. 110, No. 1, pp. 29-31.

Hofman et al., CYP7A1 A-278C Polymorphism Affects the Response of Plasma Lipids after Dietary Cholesterol or Cafestol Interventions in Humans, The Journal of Nutrition, 2004, pp. 2200-2204.

Pullinger et al., Human cholesterol 7α-hydroxylase (CYP7A1) deficiency has a hypercholesterolemic phenotype, J. Clin. Invest. 110:109-117 (2002).

Akinc et al., Targeted Delivery of RNAi Therapeutics With Endogenous and Exogenous Ligand-Based Mechanisms, Mol Ther. 2009 17:872-879.

Yamamoto et al., Current prospects for mRNA gene delivery, European Journal of Pharmaceutics and Biopharmaceutics 71 (2009) 484-489.

(56) References Cited

OTHER PUBLICATIONS

Biocca, S., et al., Intracellular expression of anti-p21^ras single chain Fv fragments inhibits meiotic maturation of xenopus oocytes. Biochem Biophys Res Comm. Dec. 15, 1993; 197(2): 422-427.
Bird, A.P. et al., CpG-rich islands and the function of DNA methylation. Nature. May 15-21, 1986;321(6067):209-13.
Black, D.D. et al., Similarity of the transfer factors in Novikoff ascites tumor and other amino acid-incorporating systems. Cancer Res. May 1970;30(5):1281-6.
Bloch, G. et al., Sequence-dependence of the conformational changes induced by the 5-methyl cytosine in synthetic RNA oligomers. FEBS Lett. Jul. 27, 1987;219(2):464-8.
Boczkowski, D. et al., Dendritic cells pulsed with RNA are potent antigen-presenting cells in vitro and in vivo. J Exp Med. Aug. 1, 1996;184(2):465-72.
Boczkowski, D. et al., Induction of tumor immunity and cytotoxic T lymphocyte responses using dendritic cells transfected with messenger RNA amplified from tumor cells. Cancer Res. Feb. 15, 2000;60(4):1028-34.
Bonehill, A., et al., Single-step antigen loading and activation of dendritic cells by mRNA electroporation for the purpose of therapeutic vaccination in melanoma patients. Clin Cancer Res. May 2009; 15(10): 3366-3375.
Boon, T. et al., Genes coding for tumor rejection antigens: perspectives for specific immunotherapy. Important Adv Oncol. 1994:53-69.
Bose, S. et al., Role of nucleolin in human parainfluenza virus type 3 infection of human lung epithelial cells. J Virol. Aug. 2004;78(15):8146-58.
Bouxsein, N.F., et al., Structure and gene silencing activities of monovalent and pentavalent cationic lipid vectors complexed with siRNA†. Biochem. 2007; 46(16): 4785-4792.
Brandt, B. et al., Detection of the metastatic potential of blood-borne and immunomagnetically enriched epithelial cells by quantitative erbB-2 RT-PCR. Clin Exp Metastasis. Sep. 1996;14(4):399-408.
Brieba, L.G., et al., Role of T7 RNA polymerase His784 in start site selection and initial transcription. Biochem. 2002; 41: 5144-5149.
Brossart, P. et al., Her-2/neu-derived peptides are tumor-associated antigens expressed by human renal cell and colon carcinoma lines and are recognized by in vitro induced specific cytotoxic T lymphocytes. Cancer Res. Feb. 15, 1998;58(4):732-6.
Brossart, P. et al., Identification of HLA-A2-restricted T-cell epitopes derived from the MUC1 tumor antigen for broadly applicable vaccine therapies. Blood. Jun. 15, 1999;93(12):4309-17.
Brossart, P. et al., Induction of cytotoxic T-lymphocyte responses in vivo after vaccinations with peptide-pulsed dendritic cells. Blood. Nov. 1, 2000;96(9):3102-8.
Brossart, P. et al., Virus-mediated delivery of antigenic epitopes into dendritic cells as a means to induce CTL. J Immunol. Apr. 1, 1997;158(7):3270-6.
Buccoliero, R. et al., Elevation of lung surfactant phosphatidylcholine in mouse models of Sandhoff and of Niemann-Pick A disease. J Inherit Metab Dis. 2004;27(5):641-8.
Burke, B. et al., Microinjection of mRNA coding for an anti-Golgi antibody inhibits intracellular transport of a viral membrane protein. Cell. Apr. 1984;36(4):847-56.
Burks, E.A. et al, In vitro scanning saturation mutagenesis of an antibody binding pocket. Proc Natl Acad Sci U S A. Jan. 21, 1997;94(2):412-7.
Butler, E.T. et al., Bacteriophage SP6-specific RNA polymerase. I. Isolation and characterization of the enzyme. J Biol Chem. May 25, 1982;257(10):5772-8.
Cannon, G. et al., RNA based vaccines. DNA Cell Biol. Dec. 2002;21(12):953-61.
Capoccia, B.J., et al., G-CSF and AMD3100 mobilize monocytes into the blood that stimulate angiogenesis in vivo through a paracrine mechanism. Blood. Oct. 1, 2006; 108(7): 2438-2445.
Caput, D. et al., Identification of a common nucleotide sequence in the 3'-untranslated region of mRNA molecules specifying inflammatory mediators. Proc Natl Acad Sci U S A. Mar. 1986;83(6):1670-4.
Caron, H. et al., The human transcriptome map: clustering of highly expressed genes in chromosomal domains. Science. Feb. 16, 2001;291(5507):1289-92.
Carralot, J.P. et al., Polarization of immunity induced by direct injection of naked sequence-stabilized mRNA vaccines. Cell Mol Life Sci. Sep. 2004;61(18):2418-24.
Carralot, J.P. et al., Production and characterization of amplified tumor-derived cRNA libraries to be used as vaccines against metastatic melanomas. Genet Vaccines Ther. Aug. 22, 2005;3:6.
Caudy, A.A. et al., Fragile X-related protein and VIG associate with the RNA interference machinery. Genes Dev. Oct. 1, 2002;16(19):2491-6.
Cavaille, J. et al., Identification of brain-specific and imprinted small nucleolar RNA genes exhibiting an unusual genomic organization. Proc Natl Acad Sci U S A. Dec. 19, 2000;97(26):14311-6.
Cavaille, J. et al., Targeted ribose methylation of RNA in vivo directed by tailored antisense RNA guides. Nature. Nov. 24, 1996;383(6602):732-5.
Celluzzi, C.M. et al., Peptide-pulsed dendritic cells induce antigen-specific CTL-mediated protective tumor immunity. J Exp Med. Jan. 1, 1996;183(1):283-7.
Chan, E. et al., Live cell imaging distinguishes bona fide human iPS cells from partially reprogrammed cells. Nat Biotech. Nov. 2009: 27(11): 1033-1037.
Chappell, S.A. et al., Ribosomal tethering and clustering as mechanisms for translation initiation. Proc Natl Acad Sci U S A. Nov. 28, 2006;103(48):18077-82. Epub Nov. 16, 2006.
Charette, M. et al., Pseudouridine in RNA: what, where, how, and why. IUBMB Life. May 2000;49(5):341-51.
Chen, D., et al., Rapid discovery of potent siRNA-containing lipid nanoparticles enabled by controlled microfluidic formulation. J Am Chem Soc. 2012; 134: 6948-6951.
Chen, H., et al., TGF-beta 1 attenuates myocardial ischemia-reperfusion injury via inhibition of upregulation of MMP-1. Am J Physiol Heart Circ Physiol. May 2003; 284(5): H1612-7.
Chen, Z. et al., Enhanced protection against a lethal influenza virus challenge by immunization with both hemagglutinin- and neuraminidase-expressing DNAs. Vaccine. Feb. 26, 1999;17(7-8):653-9.
Cheng, C., et al., Multifunctional triblock copolymers for intracellular messenger RNA delivery. Biomaterials. Oct. 2012; 33(28): 6868-6876.
Cheng, W.F. et al., Enhancement of Sindbis virus self-replicating RNA vaccine potency by linkage of herpes simplex virus type 1 VP22 protein to antigen. J Virol. Mar. 2001;75(5):2368-76.
Cheng, W.F. et al., Enhancement of Sindbis virus self-replicating RNA vaccine potency by linkage of *Mycobacterium tuberculosis* heat shock protein 70 gene to an antigen gene. J Immunol. May 15, 2001;166(10):6218-26.
Cho, J.H. et al., Enhanced cellular immunity to hepatitis C virus nonstructural proteins by codelivery of granulocyte macrophage-colony stimulating factor gene in intramuscular DNA immunization. Vaccine. Mar. 5, 1999;17(9-10):1136-44.
Chui, H.M. et al., Synthesis of helix 69 of *Escherichia coli* 23S rRNA containing its natural modified nucleosides, m(3) Psi and Psi. J Org Chem. Dec. 13, 2002;67(25):8847-54.
Clawson, G.A. et al., Increased amounts of double-stranded RNA in the cytoplasm of rat liver following treatment with carcinogens. Cancer Res. Aug. 1982;42(8):3228-31.
Cohen, P.J. et al., Murine epidermal Langerhans cells and splenic dendritic cells present tumor-associated antigens to primed T cells. Eur J Immunol. Feb. 1994;24(2):315-9.
Collas, P. et al., Epigenetic reprogramming of nuclei using cell extracts. Stem Cell Rev. 2006;2(4):309-17.
Binder, R. et al., Evidence that the pathway of transferrin receptor mRNA degradation involves an endonucleolytic cleavage within the 3' UTR and does not involve poly(A) tail shortening. EMBO J. Apr. 15, 1994;13(8):1969-80.

(56) References Cited

OTHER PUBLICATIONS

Collas, P., Dedifferentiation of cells: new approaches. Cytotherapy. 2007;9(3):236-44.
Colter, J.S., et al., Infectivity of ribonucleic acid isolated from virus-infected tissues. Virology. 1957; 4(3): 522-532.
Colot, V. et al., Eukaryotic DNA methylation as an evolutionary device. Bioessays. May 1999;21(5):402-11.
Colter, J.S., et al., Infectivity of ribonucleic acid from Ehrlich Ascites tumour cells infected with Mengo Encephalitis. Nature. Apr. 1957; 179(4565): 859-860.
Condon, C. et al., DNA-based immunization by in vivo transfection of dendritic cells. Nat Med. Oct. 1996;2(10):1122-8.
Kuhn, E., et al., Developing multiplexed assays for Troponin I and Interleukin-33 in plasma by peptide immunoaffinity enrichment and targeted mass spectrometry. Clinical Chem. 2009; 55(6): 1108-1117.
Kundu, T.K. et al., CpG islands in chromatin organization and gene expression. J Biochem. Feb. 1999;125(2):217-22.
Kusakabe, K. et al., The timing of GM-CSF expression plasmid administration influences the Th1/Th2 response induced by an HIV-1-specific DNA vaccine. J Immunol. Mar. 15, 2000;164(6):3102-11.
Kvasnica, M. et al., Platinum(II) complexes with steroidal esters of L-methionine and L-histidine: synthesis, characterization and cytotoxic activity. Bioorg Med Chem. Apr. 1, 2008;16(7):3704-13. Epub Feb. 7, 2008.
Kwoh, D.Y. et al., Transcription-based amplification system and detection of amplified human immunodeficiency virus type 1 with a bead-based sandwich hybridization format. Proc Natl Acad Sci U S A. Feb. 1989;86(4):1173-7.
Kwissa, M. et al., Cytokine-facilitated priming of CD8+ T cell responses by DNA vaccination. J Mol Med (Berl). Feb. 2003;81(2):91-101. Epub Nov. 22, 2002.
Lacour, F. et al., Transplantable malignant tumors in mice induced by preparations containing ribonucleic acid extracted from human and mouse tumors. J. Natl Cancer Inst., 1960, 24(2):301-27.
Lai, C.J. et al., Patterning of the neural ectoderm of Xenopus laevis by the amino-terminal product of hedgehog autoproteolytic cleavage. Development. Aug. 1995;121(8):2349-60.
Lai, S.K., et al., Rapid transport of large polymeric nanoparticles in fresh undiluted human mucus. PNAS. Jan. 30, 2007; 104(5): 1482-1487.
Lai, S.K., et al., Mucus-penetrating nanoparticles for drug and gene delivery to mucosal tissues. Adv Drug Deliv Rev. Feb. 27, 2009; 61(2): 158-171.
Lange, T.S. et al., Transient nucleolar localization of U6 small nuclear RNA in Xenopus Laevis oocytes. Mol Biol Cell. Jul. 2000;11(7):2419-28.
Langford, C.J. et al., Evidence for an intron-contained sequence required for the splicing of yeast RNA polymerase II transcripts. Cell. Jun. 1983;33(2):519-27.
Larregina, A.T. et al., Changing paradigms in cutaneous immunology: adapting with dendritic cells. J Invest Dermatol. Jan. 2005;124(1):1-12.
Latarjet, R., Production of multiple cancers in mice having received nucleic acid extract from isologous & homologous leukemic tissues. C.R. Hebd Seances Acad. Sci., 1958, 246(5):853-5.
Lathe, R., Synthetic oligonucleotide probes deduced from amino acid sequence data: Theoretical and practical considerations. J Mol Biol. May 5, 1985;183(1):1-12.
Leader B., et al., Protein therapeutics: a summary and pharmacological classification. Nat Rev Drug Discov. Jan. 2008; 7(1): 21-39.
Lee, G. et al., Modeling pathogenesis and treatment of familial dysautonomia using patient-specific iPSCs. Nature. Sep. 17, 2009;461(7262):402-6. Epub Aug. 19, 2009.
Lee, J. et al., Molecular basis for the immunostimulatory activity of guanine nucleoside analogs: activation of Toll-like receptor 7. Proc Natl Acad Sci U S A. May 27, 2003;100(11):6646-51. Epub May 8, 2003.
Lee, J. T., et al., An arginine to glutamine mutation in residue 109 of human ornithine transcarbamylase completely abolishes enzymatic activity in Cos1 cells. J. Clin. Invest. Dec. 1989; 84: 1762-1766.
Lehto, T., et al., Cell-penetrating peptides for the delivery of nucleic acids. Expert Opin. Drug Deliv. Jul. 2012; 9(7): 823-836.
Leitner, W.W. et al., DNA and RNA-based vaccines: principles, progress and prospects. Vaccine. Dec. 10, 1999;18 (9-10):765-77.
Lenz, A. et al., Human and murine dermis contain dendritic cells. Isolation by means of a novel method and phenotypical and functional characterization. J Clin Invest. Dec. 1993;92(6):2587-96.
Lerner, M.R. et al., Are snRNPs involved in splicing? Nature. Jan. 10, 1980;283(5743):220-4.
Lesaffre, B. et al., Direct non-cell autonomous Pax6 activity regulates eye development in the zebrafish. Neural Dev. Jan. 17, 2007;2:2.
Lewandowski, L.J. et al., Separation of the infectious ribonucleic acid of potato spindle tuber virus from double-stranded ribonucleic acid of plant tissue extracts. J Virol. Nov. 1971;8(5):809-12.
Lewis, David, Dynamic Polyconjugates (DPC) Technology: An elegant solution to the siRNA delivery problem. Arrowhead Research Corp (NASDAQ: ARWR). Nov. 2011.
Lewis, J.D. et al., the influence of 5' and 3' end structures on pre-mRNA metabolism. J Cell Sci Suppl. 1995;19:13-9.
Lewis, J.K., et al., Matrix-assisted laser desorption/ionization mass spectrometry in peptide and protein analysis. Enc of Anal Chem. 2000; R.A. Meyers (Ed.) 5880-5894.
Li, L. et al., Preparation and gene delivery of alkaline amino acids-based cationic liposomes. Arch Pharm Res. Jul. 2008;31(7):924-31. Epub Aug. 14, 2008.
Li, L. et al., Overcoming obstacles to develop effective and safe siRNA therapeutics. Expert Opin Biol Ther. May 2009; 9(5): 609-19.
Li, X. et al., Generation of destabilized green fluorescent protein as a transcription reporter. J Biol Chem. Dec. 25, 1998;273(52):34970-5.
Lian, T. et al., Trends and developments in liposome drug delivery systems. J Pharm Sci. Jun. 2001;90(6):667-80.
Liang, X.H. et al., The spliced leader-associated RNA is a trypanosome-specific sn(o) RNA that has the potential to guide pseudouridine formation on the SL RNA. RNA. Feb. 2002;8(2):237-46.
Licatalosi, D.D. et al., Splicing regulation in neurologic disease. Neuron. Oct. 5, 2006;52(1):93-101.
Linehan, D.C. et al., Tumor-specific and HLA-A2-restricted cytolysis by tumor-associated lymphocytes in human metastatic breast cancer. J Immunol. Nov. 1, 1995;155(9):4486-91.
Lobenberg, R. et al., Improved body distribution of 14C-labelled AZT bound to nanoparticles in rats determined by radioluminography. J Drug Target. 1998;5(3):171-9.
Loging, W.T. et al., Identifying potential tumor markers and antigens by database mining and rapid expression screening. Genome Res. Sep. 2000;10(9):1393-402.
Lopez, M.F., et al., Selected reaction monitoring-mass spectrometric immunoassay responsive to parathyroid hormone and related variants. Clinical Chem. 2010; 56(2): 281-290.
Lopez-Berestein, G. et al., Treatment of systemic fungal infections with liposomal amphotericin B. Arch Intern Med. Nov. 1989;149(11)2533-6.
Lorenzi, J.C., et al., Intranasal vaccination with messenger RNA as a new approach in gene therapy: Use against tuberculosis. BMC Biotechnol. Oct. 2010; 10(77): 1-11.
Lowe, T.M. et al., A computational screen for methylation guide snoRNAs in yeast. Science. Feb. 19, 1999;283(5405):1168-71.
Lowry, W.E., et al., Generation of human induced pluripotent stem cells from dermal fibroblasts. Proc Natl Acad Sci USA. Feb. 2008; 105(8): 2883-2888.
Lukkonen, B.G. et al., A conditional U5 snRNA mutation affecting pre-mRNA splicing and nuclear pre-mRNA retention identifies SSD1/SRK1 as a general splicing mutant suppressor. Nucleic Acids Res. Sep. 1, 1999;27(17):3455-65.
Lund, P.E., et al., Pseudovirions as vehicles for the delivery of siRNA. Pharm Res. Mar. 2010; 27(3): 400-420. Epub Dec. 9, 2009.

(56) References Cited

OTHER PUBLICATIONS

Luo, D. et al., Synthetic DNA delivery systems. Nat Biotechnol. Jan. 2000;18(1):33-7.
Ma, X. et al., Pseudouridylation (Psi) of U2 snRNA in S. cerevisiae is catalyzed by an RNA-independent mechanism. EMBO J. Apr. 15, 2003;22(8):1889-97.
Mackie, G.A., Vectors for the synthesis of specific RNAs in vitro. Biotechnology. 1988;10:253-67.
Maden, B.E.H. et al., Classical and novel approaches to the detection and localization of the numerous modified nucleotides in eukaryotic ribosomal RNA. Biochimie. 1995;77(1-2):22-9.
Langer, R., New methods of drug delivery. Science. Sep. 28, 1990;249(4976):1527-33.
Magee, W.E. et al., Marked stimulation of lymphocyte-mediated attack on tumor cells by target-directed liposomes containing immune RNA, Cancer Res., 1978, 38(4):1173-6.
Nakamura, K. et al.,The proliferation of plasma cells from mouse bone marrow in vitro. III. Primary and secondary immune responses associated with thymic RNA. Immunol Commun. 1979;8(5-6):511-29.
Nakamura, K., The proliferation of plasma cells from mouse bone marrow in vitro. II-Stimulation of IgG-producing cells by a RNase-sensitive thymocyte homogenate. Cell Immunol. Aug. 1976;25(2):163-77.
Nallagatla, S.R. et al., A brilliant disguise for self RNA: 5'-end and internal modifications of primary transcripts suppress elements of innate immunity. RNA Biol. Jul.-Sep. 2008;5(3):140-4. Epub Jul. 20, 2008.
Narayanan, A. et al., Role of the box C/D motif in localization of small nucleolar RNAs to coiled bodies and nucleoli. Mol Biol Cell. Jul. 1999;10(7)2131-47.
Naz, R.K. et al., Novel human prostate-specific cDNA: molecular cloning, expression, and immunobiology of the recombinant protein. Biochem Biophys Res Commun. Oct. 11, 2002;297(5):1075-84.
Needleman, S.B. et al., A general method applicable to the search for similarities in the amino acid sequence of two proteins. J Mol Biol. Mar. 1970;48(3):443-53.
Nestle, F.O. et al., Vaccination of melanoma patients with peptide- or tumor lysate-pulsed dendritic cells. Nat Med. Mar. 1998;4(3):328-32.
Neumann, E. et al., Fundamentals of electroporative delivery of drugs and genes. Bioelectrochem Bioenerg. Feb. 1999;48(1):3-16.
Newby, M.I. et al., Sculpting of the spliceosomal branch site recognition motif by a conserved pseudouridine. Nat Struct Biol. Dec. 2002;9(12):958-65.
Newman, A. et al., Mutations in yeast U5 snRNA alter the specificity of 5' splice-site cleavage. Cell. Apr. 5, 1991;65(1):115-23.
Newman, A.J. et al., U5 snRNA interacts with exon sequences at 5' and 3' splice sites. Cell. Feb. 21, 1992;68(4):743-54.
Newmark, J. et al., Preparation and properties of adducts of streptokinase and streptokinase-plasmin complex with poly ethylene glycol and pluronic polyol F38. J Appl Biochem. 1982; 4:185-9.
Ni, J. et al., Small nucleolar RNAs direct site-specific synthesis of pseudouridine in ribosomal RNA. Cell. May 16, 1997;89(4):565-73.
Nicholson, A.W. et al., Accurate in vitro cleavage by RNase III of phosphorothioate-substituted RNA processing signals in bactenophage T7 early mRNA. Nucleic Acids Res. Feb. 25, 1988;16(4):1577-91.
Nielsen, D.A. et al., Preparation of capped RNA transcripts using T7 RNA polymerase. Nucleic Acids Res. Jul. 25, 1986;14(14):5936.
Nielsen, P.E., Peptide nucleic acids as therapeutic agents. Curr Opin Struct Biol. Jun. 1999;9(3):353-7.
Nikolin, V.P. et al., Resistance of Mice Exposed to Whole-Body Irradiation to Transplanted Hemopoietic Cells Modified with RNA Preparations. Bull. Exp. Biol. Med., 2000, 129:5571-4.
Niu, M.C. et al., Genetic Manipulation in Higher Organisms; III. Detection of Soya Protein in Seeds Derived from Soya mRNA-Treated Rice. Scientia Sinica, 1980, 23:119-23.

Niu, M.C. et al., Ribonucleic acid-induced changes in mammalian cells. Proc Natl Acad Sci U S A. Oct. 15, 1961;47:1689-700.
Matsuda, A. et al., Nucleosides. 120. Synthesis of 2'-Deoxy-?-isocytidine and 2'-Deoxy-1-methyl-?-uridine from ?-Uridine^1. J Org Chem. 1981; 46:3603-3609.
Matsuda, A. et al., Synthesis of 3-Methylpseudouridine and 2'-Deoxy-3-Methyl-pseudouridine. Carbohydr Res. Mar. 1, 1982; 100: 297-302.
Bhattacharya, B.K. et al., A practical synthesis of N1-Methyl-2'-deoxy-?-uridine (?-Thymidine) and its incorporation into G-rich triple helix forming oligonucleotides. Nucleosides & Nucleotides. 1995; 14(6): 1269-1287.
Desaulniers, J.P. et al., Synthesis of 15N-enriched pseudouridine derivatives. Org Lett. Oct. 30, 2003; 5(22): 4093-4096.
Jachertz, D. et al., Treatment of P815 mastocytoma in DBA12 mice with RNA. J Immunogen. 1974; 1: 355-362.
McGary, E.C. et al., Post-transcriptional regulation of erythropoietin mRNA stability by erythropoietin mRNA-binding protein. J Biologic Chem. Mar. 28, 1997; 272(13): 8628-8634.
Hornung, V. et al., 5'-triphosphate RNA is the ligand for RIG-I. Science. Nov. 10, 2006; 314(5801): 994-997.
Davis, D.R. Stabilization of RNA stacking by pseudouridine. Nucleic Acids Res. 1995; 23(24): 5020-5026.
Monobe, M. et al., Beta-pseudouridine, a beer component, reduces radiation-induced chromosome aberrations in human lymphocytes. Mutat Res. Jul. 8, 2003; 538(1-2): 93-99.
Hanessian, S. et al., A highly stereocontrolled and efficient synthesis of alpha- and beta-pseudouridines. Tetrahedron Letters. 2003; 44: 8321-8323.
Shi, Y. et al., Identification and characterization of pancreatic eukaryotic initiation factor 2 alpha-subunit kinase, PEK, involved in translational control. Mol Cell Biol. Dec. 1998; 18(12): 7499-7509.
Nguyen, A. et al., Quantitative assessment of the use of modified nucleoside triphosphates in expression profiling: differential effects on signal intensities and impacts on expression ratios. BMC Biotechnol. Jul. 31, 2002; 2:14.
Carrington, J.C. et al., Cap-independent enhancement of translation by a plant potyvirus 5' nontranslated region. J Virol. Apr. 1990; 64(4): 1590-1597.
Gallie, D.R. The 5'-leader of tobacco mosaic virus promotes translation through enhanced recruitment of eIF4F. Nuc Acids Res. 2002; 30(15): 3401-3411.
Decatur, W.A. et al., RNA-guided nucleotide modification of ribosomal and other RNAs. J Biologic Chem. Jan. 10, 2003; 278(2): 695-698.
Badis, G. et al., A snoRNA that guides the two most conserved pseudouridine modifications within rRNA confers a growth advantage in yeast. RNA. Jul. 2003; 9(7): 771-779.
Nitin, N. et al., Peptide-linked molecular beacons for efficient delivery and rapid mRNA detection in living cells. Nuc Acids Res. 2004; 32(6): e58.
Cho, E.J. et al., mRNA capping enzyme is recruited to the transcription complex by phosphorylation of the RNA polymerase II carboxy-terminal domain. Genes Dev. Dec. 15, 1997; 11(24): 3319-3326.
Santi, D.V. Mechanistic studies of RNA modifying enzymes. RNA pseudouridine synthase and m5Cytosine methyl transferase. Nucleic Acids Symp Ser. 2000; 44: 147-148.
Strobel, I. et al., Human dendritic cells transfected with either RNA or DNA encoding influenza matrix protein M1 differ in their ability to stimulate cytotoxic T lymphocytes. Gene Ther. Dec. 2000; 7(23): 2028-2035.
Takahashi, T.T. et al., mRNA display: ligand discovery, interaction analysis and beyond. Trends in Biochem Sci. Mar. 2003; 28(3): 159-165.
Niu, M.C. et al., The Developmental Potentiality of the Liver-RNA-Treated Posterior Primitive Streak in the Chick Embryo. Biol. Bull, 1968, 135:200-7.
Niu, M.C. et al., The Entrance of Exogenous RNA into the Mouse Ascites Cell. Proc. Soc. Exp. Biol. Med., 1968, 128 (2):550-5.
Niu, M.C., RNA-Induced Biosynthesis of Specific Enzymes. PNAS, 1962, 48:1964-9.

(56) References Cited

OTHER PUBLICATIONS

Niu, M.C., Antagonistic Action of Exogenous Histone and RNA in Mouse Ascites Cells. Proc. Soc. Exp. Biol. Med., 1972, 140:256-62.

Niu, M.C., Causal Analysis of Embryonic Differentiation; I. Responsiveness of Presumptive Ectoderm as a Regulating Factor in RNA Function. Exp. Cell Res., 1971, 64:57-64.

Niu, M.C., Causal Analysis of Embryonic Differentiation; II. Dual Function of Exogenous RNA in differentiation of Presumptive Ectoderm. Exp. Cell Res., 1971, 64:65-76.

Niu, M.C., Current Evidence Concerning Chemical Inducers. Evolution of Nervous Control from Primitive Organisms. 1959, 7-30.

Niu, M.C., Functional Potentiality of Ribonucleic Acid. Acta. Unio. Int. Contra. Cancrum, third meeting Philadelphia, 1964, 20:995-6.

Niu, M.C., Genetic manipulation in higher organisms; I. Goldfish ova as materials of operation, mRNA mediated alteration of the liver specific isozymes. Scientia Sinica, 1977, 20(6):803-8.

Ma, B. et al., HPV pseudovirions as DNA delivery vehicles. Ther Deliv. Apr. 2011; 2(4): 427-430.

Malone, R.W. et al., Cationic liposome-mediated RNA transfection. Proc Natl Acad Sci U S A. Aug. 1989;86(16):6077-81.

Niu, M.C., Glucose-6-Phosphate: Re-examination of the RNA-Induced Activity in Mouse Ascites Tumor Cells. Science. 1965, 148:513-6.

Niu, M.C., Mode of Action of the Exogenous Ribonucleic Acid in Cell Function. Natl Cancer Inst. Monogr. 1964, 13:167-77.

Niu, M.C., et al., Poly(A)-attached RNA as activator in embryonic differentiation. Proc Soc Exp Biol Med. Oct. 1974;147(1):318-22.

Niu, M.C., et al., Presence of liver-forming fraction in fish egg mRNAs detected by its ability to encode albumin synthesis. Scientia Sinica, 1980, 23(4):510-6.

Niu, M.C., et al., Re-examination of the DNA-mediated transformation in goldfish. Scientia Sinica, 1983, 24(7):700-7.

Niu, M.C., The Development of Tubular heart in RNA-Treated Post-Nodal pieces of Chick Blastoderm. J Embryol. Exp. Morphol., 1973, 29:485-501.

Niu, M.C., The Effect of mRNA on Nuclear Activity in Developing Systems. 1980, 415-33.

Niu, M.C., The role of Exogenous Heart-RNA in Development of the Chick Embryo Cultivated In Vitro. J Embryol. Exp. Morphol., 1970, 64:57-64.

Niu, M.C., Thymus Ribonucleic Acid and Embryonic Differentiation. PNAS, 1958, 44:1264-1274.

Niu, M.C. et al., Transfer of information from mRNA to chromosomes by reverse transcription in early development of goldfish eggs. Cellular and Molecular Biology, 1989, 35(3):333-45.

Niu, M.C., VII. New Approaches to the Problem of Embryonic Induction. Cellular Mechanisms, Differentiation and Growth. 1956, 155-71.

Oberhauser, B. et al., Effective incorporation of 2'-O-methyl-oligoribonucleotides into liposomes and enhanced cell association through modification with thiocholesterol. Nucleic Acids Res. Feb. 11, 1992;20(3):533-8.

Occhiogrosso, G., et al., Prolonged convection-enhanced delivery into the rat brainstem. Neurosurgery. Feb. 2003; 52(2): 388-394.

Odens, M., Prolongation of the Life Span in Rats. Journal of the American Geriatrics Soc. Oct. 1973; 11(10):450-1.

O'Doherty, U. et al., Human blood contains two subsets of dendritic cells, one immunologically mature and the other immature. Immunology. Jul. 1994;82(3):487-93.

Ofengand, J. et al., The function of pseudouridylic acid in transfer ribonucleic acid: II. Inhibition of amino acyl transfer ribonucleic acid-ribosome complex formation by ribothymidylyl-pseudouridylyl-cytidylyl-guanosine 3'-phosphate. J Biol Chem. Nov. 25, 1969; 244(22): 6241-6253.

Ohashi, H. et al., Efficient protein selection based on ribosome display system with purified components. Biochem Biophys Res Commun. Jan. 5, 2007;352(1):270-6. Epub Nov. 13, 2006.

Ohmichi, T. et al., Efficient bacterial transcription of DNA nanocircle vectors with optimized single-stranded promoters. Ohmichi T, Maki A, Kool ET. Proc Natl Acad Sci U S A. Jan. 8, 2002;99(1):54-9. Epub Dec. 18, 2001.

Okumura, K., et al., Bax mRNA therapy using cationic liposomes for human malignant melanoma. J Gene Med. 2008; 10: 910-917.

Owen, M. et al., Stromal stem cells: marrow derived osteogenic precursors. CIBA Foundation Symposium, 1988, 136:42-60.

Ozawa, T. et al., Amplification and analysis of cDNA generated from a single cell by 5'-RACE: application to isolation of antibody heavy and light chain variable gene sequences from single B cells. Biotechniques. Apr. 2006;40(4):469-70.

Padilla, R. et al., A Y639F/H784A T7 RNA polymerase double mutant displays superior properties for synthesizing RNAs with non-canonical NTPs. Nucleic Acids Res. Dec. 15, 2002;30(24):e138.

Paglia, P. et al., Murine dendritic cells loaded in vitro with soluble protein prime cytotoxic T lymphocytes against tumor antigen in vivo. J Exp Med. Jan. 1, 1996;183(1):317-22.

Painter, H., et al., 494. Topical delivery of mRNA to the murine lung and nasal epithelium. Mol Ther. 2004; 9: S187.

Palu, G. et al., In pursuit of new developments for gene therapy of human diseases. J Biotechnol. Feb. 5, 1999;68(1):1-13.

Palucka, A.K. et al., Taming cancer by inducing immunity via dendritic cells. Immunol Rev. Dec. 2007;220:129-50.

Papapetrou, E., et al., Stoichiometric and temporal requirements of Oct4, Sox2, Klf4, and c-Myc expression for efficient human iPSC induction and differentiation. Natl. Acad. Sci USA. Aug. 2009; 106: 12759-12764.

Paradi, E. et al., Changes in the content of modified nucleotides in wheat rRNA during greening. Biologia Plantarum. Apr. 2003/4; 47(1):33-8.

Park, I., et al., Reprogramming of human somatic cells to pluripotency with defined factors. Nature. Jan. 2008; 451(10): 141-146.

Parker, R. et al., Recognition of the TACTAAC box during mRNA splicing in yeast involves base pairing to the U2-like snRNA. Cell. Apr. 24, 1987;49(2):229-39.

Pascolo, S. Vaccination with messenger RNA (mRNA). Handb Exp Pharmacol. 2008; 183:221-235.

Passini, M.A. et al., AAV vector-mediated correction of brain pathology in a mouse model of Niemann-Pick A disease. Mol Ther. May 2005;11(5):754-62.

Passos, G.A. et al., In vivo induction of immunological memo immune memory to human tumor extract with poly (A)-containing mmune RNA. Cell Mol Biol. 1988;34(2):157-64.

Paul, S et al., How to improve R&D productivity: the pharmaceutical industry's grand challenge. Nat Reviews Drug Discovery. Mar. 2010; 9: 203-214.

Pays, E., Characterization of double-stranded ribonucleic acid sequences present in the initial transcription products of rat liver chromatin. Biochem J. Aug. 1, 1977;165(2):237-45.

Pearson, W.R. et al., Improved tools for biological sequence comparison. Proc Natl Acad Sci U S A. Apr. 1988;85(8):2444-8.

Peculis, B. RNA processing: pocket guides to ribosomal RNA. Curr Biol. Aug. 1, 1997;7(8):R480-2.

Peng, Z.H. et al., Synthesis and application of a chain-terminating dinucleotide mRNA cap analog. Org Lett. Jan. 24, 2002;4(2)161-4.

Peoples, G.E. et al., Breast and ovarian cancer-specific cytotoxic T lymphocytes recognize the same HER2/neu-derived peptide. Proc Natl Acad Sci U S A. Jan. 17, 1995;92(2):432-6.

Perche, F., et al., Enhancement of dedritic cells transfection in vivo and of vaccination against B16F10 melanoma with mannosylated histidylated lipopolyplexes loaded with tumor antigen messenger RNA. Nanomed: Nanotech, Bio, and Med. Aug. 2011; 7(4): 445-453.

Pesole, G. et al., Structural and functional features of eukaryotic mRNA untranslated regions. Gene. Oct. 3, 2001;276(1-2):73-81.

Pesole, G. et al., UTRdb and UTRsite: specialized databases of sequences and functional elements of 5' and 3' untranslated regions of eukaryotic mRNAs. Update 2002. Nucleic Acids Res. Jan. 1, 2002;30(1):335-40.

Petit, I., et al., G-CSF induces stem cell mobilization by decreasing bone marrow SDF-I and up-regulating CXCR4. Nature Immunology. Jul. 2002; 3(7): 687-694.

(56) References Cited

OTHER PUBLICATIONS

Phillips, J. et al., Antisense RNA Amplification: A Linear Amplification Method for Analyzing the mRNA Population from Single Living Cells. Methods. Dec. 1996;10(3):283-8.
Phizicky, E.M. et al., [31] Biochemical genomics approach to map activities to genes. Methods Enzymol. 2002;350:546-59.
Pollard, C., et al., Type I IFN counteracts the induction of antigen-specific immune responses by lipid-based delivery of mRNA vaccines. Mol Ther. Jan. 2013; 21(1): 251-259.
Ponsaerts, P. et al., Cancer immunotherapy using RNA-loaded dendritic cells. Clin Exp Immunol. Dec. 2003;134(3):378-84.
Ponsaerts, P. et al., Messenger RNA electroporation is highly efficient in mouse embryonic stem cells: successful FLPe- and Cre-mediated recombination. Gene Ther. Nov. 2004;11(21):1606-10.
Ponsaerts, P., et al., Highly efficient mRNA-based gene transfer in feeder-free cultured H-9 human embryonic stem cells. Cloning and Stem Cells. 2004; 6(3): 211-216.
Ponsaerts, P. et al., Messenger RNA electroporation of human monocytes, followed by rapid in vitro differentiation, leads to highly stimulatory antigen-loaded mature dendritic cells. J Immunol. Aug. 15, 2002;169(4):1669-75.
Porgador, A. et al., Induction of antitumor immunity using bone marrow-generated dendritic cells. J Immunol. Apr. 15, 1996;156(8):2918-26.
Pradilla, G. et al., Prevention of vasospasm following subarachnoid hemorrhage in rabbits by anti-CD11/CD18 monoclonal antibody therapy. J Neurosurg. Jul. 2004;101(1):88-92.
Preisler, H.D. et al., Sensitization in vitro to murine myeloblastic leukemia cells by xenogeneic immune RNA. J Natl Cancer Inst. Jan. 1979;62(1):133-7.
Preiss, T. et al., Dual function of the messenger RNA cap structure in poly(A)-tail-promoted translation in yeast. Nature. Apr. 2, 1998;392(6675):516-20.
Probst, J., et al., Spontaneous cellular uptake of exogenous messenger RNA in vivo is nucleic acid-specific, saturable and ion dependent. Gene Therapy. 2007; 14: 1175-1180.
Puga, A. et al., Difference between functional and structural integrity of messenger RNA. Proc Natl Acad Sci U S A. Jul. 1973;70(7):2171-5.
Pulford, B., et al., Liposome-siRNA-peptide complexes cross the blood-brain barrier and significantly decrease $PrP^C$ on neuronal cells and $PrP^{RES}$ in infected cell cultures. PLoS ONE. 2010; 5(6): e11085.
Purchio, A.F. et al., [24] Methods for molecular cloning in eukaryotic cells. Methods Enzymol. 1979; 68:357-75.
Query, C.C. et al., Branch nucleophile selection in pre-mRNA splicing: evidence for the bulged duplex model. Genes Dev. Mar. 1, 1994;8(5):587-97.
Rabinovich, P.M., et al., Synthetic messenger RNA as a tool for gene therapy. Hum. Gene Ther. Oct. 2006; 17: 1027-1035.
Rabinovich, P.M., et al., Chimeric receptor mRNA transfection as a tool to generate Antineoplastic Lymphocytes. Hum. Gene Ther. Jan. 2009; 20: 51-61.
Raff, M., Adult stem cell plasticity: fact or artifact? Annu Rev Cell Dev Biol. 2003;19:1-22.
Rajagopalan, L.E. et al., Turnover and translation of in vitro synthesized messenger RNAs in transfected, normal cells. J Biol Chem. Aug. 16, 1996;271(33):19871-6.
Ramazeilles, C. et al., Antisense phosphorothioate oligonucleotides: selective killing of the intracellular parasite Leishmania amazonensis. Proc Natl Acad Sci U S A. Aug. 16, 1994;91(17):7859-63.
Rammensee, H.G. et al., Peptides naturally presented by MHC class I molecules. Annu Rev Immunol. 1993;11:213-44.
Rascati, R.J. et al., Characterization of Fv-1 gene-product-mediated resistance transfer. Intervirology. 1981;15(2):87-96.
Ratajczak, J. et al., Embryonic stem cell-derived microvesicles reprogram hematopoietic progenitors: evidence for horizontal transfer of mRNA and protein delivery. Leukemia. May 2006;20(5):847-56.
Ratajczak, J. et al., Membrane-derived microvesicles: important and underappreciated mediators of cell-to-cell communication. Leukemia. Sep. 2006;20(9):1487-95. Epub Jul. 20, 2006.
Read, M.L., et al., A versatile reducible polycation-based system for efficient delivery of a broad range of nucleic acids. Nucleic Acids Res. 2005; 33(9): e86.
Reddy, A. et al., the effect of labour and placental separation on the shedding of syncytiotrophoblast microparticles, cell-free DNA and mRNA in normal pregnancy and pre-eclampsia. Placenta. Nov. 2008;29(11):942-9. Epub Oct. 1, 2008.
Reed, R. et al., Intron sequences involved in lariat formation during pre-mRNA splicing. Cell. May 1985;41(1):95-105.
Regnier, P. et al., Degradation of mRNA in bacteria: emergence of ubiquitous features. Bioessays. Mar. 2000;22(3):235-44.
Rejman, J., et al., mRNA transfection of cervical carcinoma and mesenchymal stem cells mediated by cationic carriers. J Controlled Rel. Nov. 2010; 147(3): 385-391.
Renkvist, N. et al., A listing of human tumor antigens recognized by T cells. Cancer Immunol Immunother. Mar. 2001;50(1):3-15.
Reyes-Sandoval, A. et al., DNA Vaccines. Curr Mol Med. May 2001;1(2):217-43.
Reynolds, B.A. et al., Generation of neurons and astrocytes from isolated cells of the adult mammalian central nervous system. Science. Mar. 27, 1992;255(5052):1707-10.
Ruhnke, M. et al., Long-term culture and differentiation of rat embryonic stem cell-like cells into neuronal, glial, endothelial, and hepatic lineages. Stem Cells. 2003;21(4):428-36.
Richter, J.D., Cytoplasmic polyadenylation in development and beyond. Microbiol Mol Biol Rev. Jun. 1999;63(2):446-56.
Roberts, J.N. et al., Genital transmission of HPV in a mouse model is potentiated by nonoxynol-9 and inhibited by carrageenan. Nat Med. Jul. 2007; 13(7): 857-861.
Robbins, P.F. et al., Human tumor antigens recognized by T cells. Curr Opin Immunol. Oct. 1996;8(5):628-36.
Robinson, F. et al., Expression of human nPTB is limited by extreme suboptimal codon content. PLoS One. Mar. 12, 2008;3(3):e1801.
Robinson, H.L. et al., Protection against a lethal influenza virus challenge by immunization with a haemagglutinin-expressing plasmid DNA. Vaccine. 1993;11(9):957-60.
Robles, A.I. et al., Reduced skin tumor development in cyclin D1-deficient mice highlights the oncogenic ras pathway in vivo. Genes Dev. Aug. 15, 1998;12(16):2469-74.
Rock, K.L. et al., A new foreign policy: MHC class I molecules monitor the outside world. Immunol Today. Mar. 1996;17(3):131-7.
Rodriguez, P.L. et al., Minimal "self" peptides that inhibit phagocytic clearance and enhance delivery of nanoparticles. Science. Feb. 22, 2013; 339(6122): 971-975.
Rohloff, C.M., et al., DUROS® Technology delivers peptides and proteins at consistent rate continuously for 3 to 12 months. J Diabetes Sci Technol. May 2008; 2(3): 461-467.
Romani, N. et al., Generation of mature dendritic cells from human blood. An improved method with special regard to clinical applicability. J Immunol Methods. Sep. 27, 1996;196(2):137-51.
Romani, N. et al., Presentation of exogenous protein antigens by dendritic cells to T cell clones. Intact protein is presented best by immature, epidermal Langerhans cells. J Exp Med. Mar. 1, 1989;169(3):1169-78.
Rosa, A., et al., Synthetic mRNAs: Powerful tools for reprogramming and differentiation of human cells. Cell Stem Cell. Nov. 2010; 7: 549-550.
Rosenberg, S.A. et al., Cancer immunotherapy: moving beyond current vaccines. Nat Med. Sep. 2004;10(9):909-15.
Ross, B.S. et al., Synthesis and incorporation of 2'-O-methyl-pseudouridine into oligonucleotides. Nucleosides and Nucleotides. 1997; 16(7/9):1547-9.
Ross, J. Control of messenger RNA stability in higher eukaryotes. Trends Genet. May 1996;12(5):171-5.

(56) References Cited

OTHER PUBLICATIONS

Rossi, Derrick. Open letter Entitled "Change to mRNA Reprogramming Protocol" Publication Date: Aug. 13, 2011 ("Rossi")(available at Addgene website: http://www.addgene.org/static/data/83/87/3686c0f2-c9a2-11e0-b8a9-003048dd6500.pdf, last retrieved Mar. 17, 2013).

Ryser, M., et al., S1P1 overexpression stimulates S1P-dependent chemotaxis of human CD34+ hematopoietic progenitor cells but strongly inhibits SDF-1/CXCR4-dependent migration and in vivo homing. Mol Immunology. 2008; 46: 166-171.

Saenz-Badillos, J. et al., RNA as a tumor vaccine: a review of the literature. Exp Dermatol. Jun. 2001;10(3):143-54.

Saison-Behmoaras, T. et al., Short modified antisense oligonucleotides directed against Ha-ras point mutation induce selective cleavage of the mRNA and inhibit T24 cells proliferation. EMBO J. May 1991;10(5):1111-8.

Saito, K. et al., Cell participation in immune response by immune ribonucleic acid. I. The role of T lymphocytes in immune response by immune RNA against T-dependent antigens. Immunology. Dec. 1980;41(4):937-45.

Saito, R., et al., Distribution of liposomes into brain and rat brain tumor models by convection-enhanced delivery monitored with magnetic resonance imaging. Cancer Res. Apr. 2004; 64: 2572-2579.

Sakuma, S. et al., Mucoadhesion of polystyrene nanoparticles having surface hydrophilic polymeric chains in the gastrointestinal tract. Int J Pharm. Jan. 25, 1999;177(2):161-72.

Sallusto, F. et al., Dendritic cells use macropinocytosis and the mannose receptor to concentrate macromolecules in the major histocompatibility complex class II compartment: downregulation by cytokines and bacterial products. J Exp Med. Aug. 1, 1995;182(2):389-400.

Sallusto, F. et al., Efficient presentation of soluble antigen by cultured human dendritic cells is maintained by granulocyte/macrophage colony-stimulating factor plus interleukin 4 and downregulated by tumor necrosis factor alpha. J Exp Med. Apr. 1, 1994;179(4):1109-18.

Veres, G., et al., The molecular basis of the sparse fur mouse mutation. Science. Jul. 1987; 237(4813):415-7.

Verheggen, C. et al., Box C/D small nucleolar RNA trafficking involves small nucleolar RNP proteins, nucleolar factors and a novel nuclear domain. EMBO J. Oct. 1, 2001;20(19):5480-90.

Verheggen, C. et al., Mammalian and yeast U3 snoRNPs are matured in specific and related nuclear compartments. EMBO J. Jun. 3, 2002;21(11):2736-45.

Verma, I.M. et al., Gene therapy: promises, problems and prospects. Nature. Sep. 18, 1997;389(6648):239-42.

Verma, I.M. et al., Gene therapy: twenty-first century medicine. Annu Rev Biochem. 2005;74:711-38.

Verma, S. et al., Modified oligonucleotides: synthesis and strategy for users. Annu Rev Biochem. 1998;67:99-134.

Vilee, D.B., Ribonucleic acid: control of steroid synthesis in endocrine tissue. Science. Nov. 3, 1967;158(3801):652-3.

Villaret, D.B. et al., Identification of genes overexpressed in head and neck squamous cell carcinoma using a combination of complementary DNA subtraction and microarray analysis. Laryngoscope. Mar. 2000;110(3 Pt 1):374-81.

Virovic, L. et al., Novel delivery methods for treatment of viral hepatitis: an update. Expert Opin Drug Deliv. Jul. 2005;2(4):707-17.

Viza, D. et al., Human lymphoblastoid cells in culture replicate immune information carried by xenogeneic RNA. Differentiation. 1978;11(3):181-4.

Wagner, E. Polymers for siRNA delivery: Inspired by viruses to be targeted, dynamic, and precise. Acc Chem Res. 2012; 45(7): 1005-1013.

Wahle, E. Poly(A) tail length control is caused by termination of processive synthesis. J Biol Chem. Feb. 10, 1995; 270(6): 2800-2808.

Wang, B. et al., Gene inoculation generates immune responses against human immunodeficiency virus type 1. Proc Natl Acad Sci U S A. May 1, 1993;90(9):4156-60.

Wang, B. et al., Immunization by direct DNA inoculation induces rejection of tumor cell challenge. Hum Gene Ther. Apr. 1995;6(4):407-18.

Wang, B.S. et al., Fractionation of immune RNA capable of transferring tumor-specific cellular cytotoxicity. Cell Immunol. May 1978;37(2):358-68.

Wang, S.P. et al., Phylogeny of mRNA capping enzymes. Proc Natl Acad Sci U S A. Sep. 2, 1997;94(18):9573-8.

Wang, Y., et al., Systemic delivery of modified mRNA encoding herpes simplex virus 1 thymidine kinase for targeted cancer gene therapy. Mol Therapy. 2012; 11:1-10.

Warren, T.L. et al., Uses of granulocyte-macrophage colony-stimulating factor in vaccine development. Curr Opin Hematol. May 2000;7(3):168-73.

Weaver, J.C., Electroporation theory. Concepts and mechanisms. Methods Mol Biol. 1995;55:3-28.

Watanabe, T. et al., Induction of wild-type p53 activity in human cancer cells by ribozymes that repair mutant p53 transcripts. Proc Natl Acad Sci U S A. Jul. 18, 2000;97(15):8490-4.

Weber, J. et al., Granulocyte-macrophage-colony-stimulating factor added to a multipeptide vaccine for resected Stage II melanoma. Cancer Jan. 1, 2003;97(1):186-200.

Weide, B. et al., Results of the first phase I/II clinical vaccination trial with direct injection of mRNA. J Immunother. Feb.-Mar. 2008;31(2):180-8.

Weide, B., et al., Direct injection of protamine-protected mRNA: Results of a phase 1/2 vaccination trial in metastatic melanoma patients. J. of Immunotherapy. Jun. 2009; 32(5): 498-507.

Nakamura, O. et al., Abstract: The Role of Immune RNA in the Immunotherapy of Malignant Brain Tumor. 1982, 34(2):333-9.

Weisberger, A.S., Induction of altered globin synthesis in human immature erythrocytes incubated with ribonucleoprotein. Proc Natl Acad Sci USA. Jan. 1962; 48(1): 68-80.

Weiss, S.B. et al., Pseudouridine Formation: Evidence for RNA as an Intermediate. Science. Jul. 23, 1965; 149(3682): 429-431.

Weissman, D. et al., Dendritic cells express and use multiple HIV coreceptors. Adv Exp Med Biol. 1997;417:401-6.

Weissman, D. et al., HIV GAG mRNA transfection of dendritic cells (DC) delivers encoded antigen to MHC class I and II molecules, causes DC maturation, and induces a potent human in vitro primary immune response. J Immunol. Oct. 15, 2000;165(8):4710-7.

Wels, W., et al., Construction, bacterial expression and characterization of a bifunctional single-chain antibody-phosphatase fusion protein targeted to the human erbb-2 receptor. Biotechnology (NY). Oct. 1992; 10(10): 1128-1132.

Wickens, M. et al., A PUF family portrait: 3'UTR regulation as a way of life. Trends Genet. Mar. 2002;18(3):150-7.

Wiehe, J.M. et al., mRNA-mediated gene delivery into human progenitor cells promotes highly efficient protein expression. J Cell Mol Med. May-Jun. 2007;11(3):521-30.

Wilkie, G.S. et al., Regulation of mRNA translation by 5'- and 3'-UTR-binding factors. Trends Biochem Sci. Apr. 2003;28(4):182-8.

Wilusz, C.J. et al., Bringing the role of mRNA decay in the control of gene expression into focus. Trends Genet. Oct. 2004;20(10):491-7.

Wilusz, J. et al., A 64 kd nuclear protein binds to RNA segments that include the AAUAAA polyadenylation motif. Cell. Jan. 29, 1988;52(2):221-8.

Winnicka, B, et al., CD13 is dispensable for normal hematopoiesis and myeloid cell functions in the mouse. J Leukoc Biol. Aug. 2010; 88(2): 347-359. Epub Apr. 29, 2010.

Wolff, J.A. et al., Direct gene transfer into mouse muscle in vivo. Science. Mar. 23, 1990;247(4949 Pt 1):1465-8.

Woltjen, K. et al., PiggyBac transposition reprograms fibroblasts to induced pluripotent stem cells. Nature. Apr. 2009 (458): 10.1038-07863.

(56) References Cited

OTHER PUBLICATIONS

Woodberry, T. et al., Immunogenicity of a human immunodeficiency virus (HIV) polytope vaccine containing multiple HLA A2 HIV CD8(+) cytotoxic T-cell epitopes. J Virol. Jul. 1999;73(7):5320-5.
Wu, J. et al., Mammalian pre-mRNA branch site selection by U2 snRNP involves base pairing. Genes Dev. Oct. 1989;3(10):1553-61.
Wu, L. et al., Fusion protein vectors to increase protein production and evaluate the immunogenicity of genetic vaccines. Mol Ther. Sep. 2000;2(3):288-97.
Wu, X.C. et al., Engineering a Bacillus subtilis expression-secretion system with a strain deficient in six extracellular proteases. J Bacteriol. Aug. 1991;173(16):4952-8.
Wurm, F. et al., Suppression of melanoma development and regression of melanoma in xiphophorine fish after treatment with immune RNA. Cancer Res. Sep. 1981;41(9 Pt 1):3377-83.
Wyatt, J.R. et al., Site-specific cross-linking of mammalian U5 snRNP to the 5' splice site before the first step of pre-mRNA splicing. Genes Dev. Dec. 1992;6(12B):2542-53.
Xu, C. et al., Feeder-free growth of undifferentiated human embryonic stem cells. Nat Biotechnol. Oct. 2001;19(10):971-4.
Xu, J. et al., Identification of differentially expressed genes in human prostate cancer using subtraction and microarray. Cancer Res. Mar. 15, 2000;60(6):1677-82.
Yamamoto, A., et al., Current prospects for mRNA gene delivery. Eur J Pharm Biopharm. Mar. 2009; 71(3): 484-489.
Yamashita, A. et al., Concerted action of poly(A) nucleases and decapping enzyme in mammalian mRNA turnover. Nat Struct Mol Biol. Dec. 2005;12(12):1054-63. Epub Nov. 13, 2005.
Yang, S.F. et al., Albumin synthesis in mouse uterus in response to liver mRNA. Proc Natl Acad Sci U S A. May 1977;74(5):1894-8.
Ye, X., et al., Prolonged metabolic correction in adult ornithine transcarbamylase-deficient mice with adenoviral vectors. Biological Chem. Feb. 1996; 271(7): 3639-3646.
Yi, Y., et al., Current advances in retroviral gene therapy. Current Gene Ther. 2011; 11: 218-228.
Ying, H. et al., Cancer therapy using a self-replicating RNA vaccine. Nat Med. Jul. 1999;5(7):823-7.
Yisraeli, J.K. et al., [4] Synthesis of long, capped transcripts in vitro by SP6 and T7 RNA Polymerases. Methods in Enzymology, vol. 180. 1989; 180, 42-50.
Yokoe, H. et al., Spatial dynamics of GFP-tagged proteins investigated by local fluorescence enhancement. Nat Biotechnol. Oct. 1996;14(10):1252-6.
Yoshida, Y. et al., Hypoxia enhances the generation of induced pluripotent stem cells. Cell Stem Cells 5. Sep. 2009; 5: 237-241.
You, Z. et al., A retrogen strategy for presentation of an intracellular tumor antigen as an exogenous antigen by dendritic cells induces potent antitumor T helper and CTL responses. Cancer Res. Jan. 1, 2001;61(1):197-205.
Yu, J. et al., Structural and functional analysis of an mRNP complex that mediates the high stability of human beta-globin mRNA. Mol Cell Biol. Sep. 2001;21(17):5879-88.
Yu, J. et al., Induced pluripotent stem cell lines derived from human somatic cells. Science. Dec. 21, 2007; 318(5858): 1917-1920.
Yu, J. et al., Human induced pluripotent stem cells free of vector and transgene sequences. Science. May 8, 2009; 324(5928): 797-801.
Yu, P.W. et al., Sustained correction of B-cell development and function in a murine model of X-linked agammaglobulinemia (XLA) using retroviral-mediated gene transfer. Blood. Sep. 1, 2004;104(5):1281-90. Epub May 13, 2004.
Yu, Y.T. et al., Internal modification of U2 small nuclear (sn)RNA occurs in nucleoli of Xenopus oocytes. J Cell Biol. Mar. 19, 2001;152(6):1279-88.
Yu, Y.T. et al., Modifications of U2 snRNA are required for snRNP assembly and pre-mRNA splicing. EMBO J. Oct. 1, 1998;17(19):5783-95.
Zebarjadian, Y. et al., Point mutations in yeast CBF5 can abolish in vivo pseudouridylation of rRNA. Mol Cell Biol. Nov. 1999;19(11):7461-72.
Zeitlin, S. et al., In vivo splicing products of the rabbit beta-globin pre-mRNA. Cell. Dec. 1984;39(3 Pt 2):589-602.
Zelcer, A. et al., The detection and characterization of viral-related double-stranded RNAs in tobacco mosaic virus-infected infected plants. Virology. Sep. 1981;113(2):417-27.
Zeytin, H.E. et al., Construction and characterization of DNA vaccines encoding the single-chain variable fragment of the anti-idiotype antibody 1A7 mimicking the tumor-associated antigen disialoganglioside GD2. Cancer Gene Ther. Nov. 2000;7(11):1426-36.
Zhang, X. et al., Advances in dendritic cell-based vaccine of cancer. Cancer Biother Radiopharm. Dec. 2002;17(6):601-19.
Zhang, Y., et al., In vivo gene delivery by nonviral vectors: overcoming hurdles? Mol. Therapy. Jul. 2012; 20(7): 1298-1304.
Zhao, X. et al., Pseudouridines in and near the branch site recognition region of U2 snRNA are required for snRNP biogenesis and pre-mRNA splicing in Xenopus oocytes. RNA. Apr. 2004;10(4):681-90.
Zhigaltsev, I.V., et al., Bottom-Up design and synthesis of limit size lipid nanoparticle systems with aqueous and triglyceride cores using milliesecond mixing. Langmuir. Feb. 21, 2012; 28(7): 3633-3640.
Zhou, W.Z. et al., RNA melanoma vaccine: induction of antitumor immunity by human glycoprotein 100 mRNA immunization. Hum Gene Ther. Nov. 1, 1999;10(16):2719-24.
Zhou, H., et al., Generation of induced pluripotent stem cells using recombinant proteins. Cell Stem Cell. May 4, 2009 (5)381-4.
Zhou, J., et al., Short Communication Bilirubin Glucuronidation Revisited: Proper assay conditions to estimate enzyme kinetics with recombinant UGT1A1. Drug metabolism and Disp. 2010; 38(11): 1907-1911.
Zhuang, Y. et al., A compensatory base change in human U2 snRNA can suppress a branch site mutation. Genes Dev. Oct. 1989;3(10):1545-52.
Zimmermann, E. et al., Electrolyte- and pH-stabilities of aqueous solid lipid nanoparticle (SLN™) dispersions in artificial gastrointestinal media. Eur J Pharm Biopharm. Sep. 2001;52(2):203-10.
Zitvogel, L. et al., Therapy of murine tumors with tumor peptide-pulsed dendritic cells: dependence on T cells, B7 costimulation, and T helper cell 1-associated cytokines. J Exp Med. Jan. 1, 1996;183(1):87-97.
Zohra, F.T., et al., Drastic effect of nanoapatite particles on liposome-mediated mRNA delivery to mammalian cells. Analytical Biochem. Oct. 2005; 345(1): 164-166.
Zohra, F.T., et al., Effective delivery with enhanced translational activity synergistically accelerates mRNA-based transfection. Biochem Biophys Res Comm. Jun. 2007; 358(1): 373-378.
Zonta, S. et al., Uretero-neocystostomy in a swine model of kidney transplantation: a new technique. J Surg Res. Apr. 2005;124(2):250-5.
Zorio, D.A. et al., Both subunits of U2AF recognize the 3' splice site in Caenorhabditis elegans. Nature. Dec. 16, 1999;402(6763):835-8.
Chang, N. et al., Genome editing with RNA-guided Cas9 nuclease in Zebrafish embryos. Cell Res. Apr. 2013; 23(4): 465-472.
Cong, L. et al., Multiplex genome engineering using CRISPR/Cas systems. Science. Feb. 15, 2013; 339(6121): 819-823.
Jinek, M. et al., A programmable dual-RNA-guided DNA endonuclease in adaptive bacterial immunity. Science. Aug. 17, 2012; 337(6096): 816-821.
Jinek, M. et al., RNA-programmed genome editing in human cells. Elife. 2013;2:e00471.
Maehr, R. et al., Generation of pluripotent stem cells from patients with type 1 diabetes. Proc Natl Acad Sci USA. Sep. 15, 2009; 106(37): 15768-15773.
Mali, P. et al., RNA-guided human genome engineering via Cas9. Science. Feb. 15, 2013; 339(6121): 823-826.
Qi, L.S. et al., Repurposing CRISPR as an RNA-guided platform for sequence-specific control of gene expression. Cell. Feb. 28, 2013; 152(5): 1173-1183.
Shen, B. et al., Generation of gene-modified mice via Cas9/RNA-mediated gene targeting. Cell Res. Apr. 2, 2013; 1-4.
International Search Report from International Application No. PCT/US10/059317 dated Aug. 22, 2011.

(56) References Cited

OTHER PUBLICATIONS

International Search Report from International Application No. PCT/US10/059305 dated Aug. 23, 2011.
Yi, P. et al., Betatrophin: A hormone that controls pancreatic beta cell proliferation. Cell. May 9, 2013; 153: 1-12.
Graf, T and Enver T. Forcing cells to change lineages. Nature. Dec. 3, 2009; 462(7273): 587-594.
Ieda, M. et al., Direct reprogramming of fibroblasts into functional cardiomyocytes by defined factors. Cell. Aug. 6, 2010; 142(3): 375-386.
Huangfu, D. et al., Induction of pluripotent stem cells from primary human fibroblasts with only Oct4 and Sox2. Nat Biotechnol. Nov. 2008; 26(11): 1269-1275.
Dong, X.Y. et al., Identification of genes differentially expressed in human hepatocellular carcinoma by a modified suppression subtractive hybridization method. Int J Cancer. Nov. 1, 2004; 112(2): 239-248.
Okita, K. et al., Generation of mouse induced pluripotent stem cells without viral vectors. Science. 2008; 322: 949-953.
Stadtfeld, M. et al., Induced pluripotent stem cells generated without viral integration. Science. Nov. 7, 2008; 322(5903): 945-949.
Aoi, T. et al., Generation of pluripotent stem cells from adult mouse liver and stomach cells. Science. Aug. 1, 2008; 321(5889): 699-702.
Feng, R. et al., PU.1 and C/EBPalpha/beta convert fibroblasts into macrophage-like cells. Proc Natl Acad Sci USA. Apr. 22, 2008; 105(16): 6057-6062.
Simon, Thorsten et al., Consolidation Treatment With Chimeric Anti-GD2-Antibody ch14.18 in Children Older Than 1 Year With Metastatic Neuroblastoma, Journal of Clinical Oncology, 2004, vol. 22, No. 17, pp. 3549-3557.
Spratlin, Jennifer L. et al., Phase I Pharmacologic and Biologic Study of Ramucirumab (IMC-1121B), a Fully Human Immunoglobulin G1 Monoclonal Antibody Targeting the Vascular Endothelial Growth Factor Receptor-2, Journal of Clinical Oncology, 2010, vol. 28, No. 5, pp. 780-787.
Steinfield, Serge et al., Epratuzumab (humanized anti-CD22 antibody) in autoimmune diseases, Expert Opinion, 2006, vol. 6, No. 9, pp. 943-949.
Stevenson, Frazier et al., The N-terminal propiece of interleukin la is a transforming nuclear oncoprotein, Proc. Natl. Acad. Sci. USA, 1997, vol. 94, No #, pp. 508-513.
William Stohl et al., Future prospects in biologic therapy for systemic lupus erythematosus, Nature Reviews, Rheumatology, No Vol., pp. 1-16.
Sullivan, David et al., Effect of a Monoclonal Antibody to PCSK9 on Low-Density Lipoprotein Cholesterol Levels in Statin-Intolerant Patients the Gauss Randomized Trial, JAMA, 2012, vol. 308, No. 23, pp. 1-10.0.
Sun, Jian, et al., B lymphocyte stimulator: a new target for treating B cell malignancies, Chinese Medical Journal, 2008; vol. 12, No. 14, pp. 1319-1323.
Tanaka, Toshio et al., Targeting Interleukin-6: All the Way to Treat Autoimmune and Inflammatory Diseases, International Journal of Biological Sciences, 2012, vol. 8 No. 9, pp. 1227-1236.
Toffoli1, Giuseppe et al., Overexpression of Folate Binding Protein in Ovarian Cancers, 1997, Int. J. Cancer (Pred. Oncol.):vol. 74, No. #, pp. 193-198.
Gevokizumab, Statement on a Nonproprietary Name Adopted by the USAN Council, No year no Volume p. 1.
Romosozumab, Statement on a Nonproprietary Name Adopted by the USAN Council, No Year , No Volume, p. 1.
Van Bezooijen, Rutger L. et al., Sclerostin is an Osteocyte-expressed Negative Regulator of Bone Formation, But Not a Classical BMP Antagonist, The Journal of Experimental Medicine, 2004, vol. 199, No. 6, pp. 805-814.
Van Bezooijen, Rutger L et al., Wnt but Not BMP Signaling is Involved in the Inhibitory Action of Sclerostin on BMP-Stimulated Bone Formation, Journal of Bone and Mineral Research, 2007, vol. 22, No. 1, pp. 1-10.
Van Cruijsen, Hester et al., Tissue micro array analysis of ganglioside N-glycolyl GM3 expression and signal transducer and activator of transcription (STAT)-3 activation in relation to dendritic cell infiltration and microvessel density in non-small cell lung cancer, BMC Cancer, 2009, vol. 9, No. 180, pp. 1-9.
Wallace, Daniel J. et al., Epratuzumab Demonstrates Clinically Meaningful Improvements in Patients with Moderate to Severe Systemic Lupus Erythematosus (SLE) Results from EMBLEM, a Phase IIB Study, ACR Concurrent Abstract Sessions, Systemic Lupus Enrthematosus—Clinical Aspects and Treatment: New Therapies, 2010, No vol., pp. 1452.
Wallace, Daniel J et al., Efficacy and safety of epratuzumab in patients with moderate/severe active systemic lupus erythematosus: results from EMBLEM, a phase IIB, randomised, double-blind, placebo-controlled, multicentre study, Ann Rheum Dis, 2014;vol. 73, No #, pp. 183-190.
Wechsler, Michael E. et al., Novel targeted therapies for eosinophilic disorders, J Allergy Clin Immunol., 2012; vol. 130, No. 3, pp. 563-571.
Werman, Ariel et al., The precursor form of IL-1_ is an intracrine proinflammatory activator of transcription, PNAS, 2004, vol. 101, No. 8, pp. 2434-2439.
WHO Drug Information, International Nonproprietary Names for Pharmaceutical Substances (INN),2013, vol. 27, No. 4, pp. 1-60.
WHO Drug Information, International Nonproprietary Names for Pharmaceutical Substances (INN), 2012, vol. 26, No. 4, pp. 1-71.
WHO Drug Information, International Nonproprietary Names for Pharmaceutical Substances (INN), 2011, vol. 25, No. 3, pp. 1-46.
WHO Drug Information, International Nonproprietary Names for Pharmaceutical Substances (INN), 2012, vol. 26, No. 2, pp. 1-79.
WHO Drug Information, International Nonproprietary Names for Pharmaceutical Substances (INN), 2012, vol. 26, No. 3, pp. 1-36.
Winkler, David G. et al. Osteocyte control of bone formation via sclerostin, a novel BMP antagonist , The EMBO Journal, 2003, vol. 22 No. 23 pp. 6267-6276.
Yang, Richard K. et al., Anti-GD2 Strategy in the Treatment of Neuroblastoma, Drugs Future, 2010 ; vol. 35, No. 8, pp. 1-15.
Yu, Alice et al., Phase I Truak of a Human-Mouse Chimeric Ant-Disialoganglioside Monoclonal Antibody ch14.18 in Patients with Refractory Neuroblastoma, and Osteosarcoma, Journal of Clinical Oncology1998, , vol. 16, No. 6, pp. 2169-2180.
Zheng, Yue et al. Intracellular Interleukin-1 Receptor 2 Binding Prevents Cleavage and Activity of Interleukin-1a, Controlling Necrosis-Induced Sterile Inflammation, Immunity,2013, vol. 38, No #, pp. 285-295.
Zhu, Min et al., Population Pharmacokinetics of Rilotumumab, a Fully Human Monoclonal Antibody Against Hepatocyte Growth Factor, in Cancer Patients, Journal of Pharmaceutical Sciences, 2014, vol. 328 No #, pp. 328-336.
Zhu, Zhenping et al., Inhibition of Vascular Endothelial Growth Factor-induced Receptor Activation with Anti-Kinase Insert Domain-containing Receptor Single-Chain Antibodies from a Phage Display Library, Cancer Research, 1998, vol. 58, No # pp. 3209-3214.
Zhu, Z et al, Inhibition of human leukemia in an animal model with human antibodies directed against vascular endothelial growth factor receptor 2. Correlation between antibody affinity and biological activity, Leukemia , 2003), vol. 17, pp. 604-611.
Zia-Amirhosseini, P. et al., Pharmacokinetics and Pharmacodynamics of SB-240563, a Humanized Monoclonal Antibody Directed to Human Interleukin-5, in Monkeys, The Journal of Pharmacology and Experimental Therapeutics, 1999, vol. 291, No. 3, pp. 1060-1067.
Stockinger, Walter et al., The PX-domain Protein SNX17 Interacts With Members of the LDL Receptor Family and Modulates Endocytosis, The EMBO Journal, 2002, vol. 21, No. 16 pp. 4259-4267.
Sorrentino, Vincenzo et al., Post-transcriptional regulation of lipoprotein receptors by the E3-ubiquitin ligase inducible degrader of the low-density lipoprotein receptor, Current Opinion, 2012, vol. 23, No. 3, pp. 213-219.
Zelcer, Noam et al., LXR Regulates Cholesterol Uptake through Idol-dependent Ubiquitination of the LDL Receptor, Science, 2009; vol. 325, No. 5936, pp. 100-104.

(56) References Cited

OTHER PUBLICATIONS

Zhang, Li et al, Both K63 and K48 ubiquitin linkages signal lysosomal degradation of the LDL receptor, Journal of Lipid Research, 2013, vol. 54, No #, pp. 1410-1420.
Lozier, Jay N, Factor IX Padua: them that have, give, Blood, 2012, vol. 120, No #, pp. 4452-4453.
Simioni, Paolo et al., X-Linked Thrombophilia with a Mutant Factor IX (Factor IX Padua), The New England Journal of Medicine, 2009, vol. 361, No. 17, pp. 1671-1675.
Cornett, Jeff et al. Update of Clinicla Trials to Cure Hemophilia, Hemophilia of Georgia, Dec. 12, 2013, No vol. pp. 1-2.
Raschke, Silja et al., Adipo-Myokines: Two Sides of the Same Coin—Mediators of Inflammation and Mediators of Exercise, Mediators of Inflammation, 2013, vol. 2013, Article ID 320724, pp. 1-16.
Podbregar, Matej et al., Cytokine Response of Cultured Skeletal Muscle Cells Stimulated with Proinflammatory Factors Depends on Differentiation Stage, The Scientific World Journal, 2013, vol. 2013, Article ID 617170, pp. 1-8.
Guerrero-Ca' zares, Hugo et al. Biodegradable Polymeric Nanoparticles Show High Efficacy and Specificity at DNA Delivery to Human Glioblastoma in Vitro and in Vivo, ACS Nano, 2014, No vol., No #, pp. 1-14.
Dahlman, James E. et al., In vivo endothelial siRNA delivery using polymeric nanoparticles with low molecular weight, Nature Nanotechnology, 2014, No vol. #, pp. 1-8.
Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, vol. 8, 'No. 4', pp. 3232-3241.
M. Kanapathipillai, et al., Nanoparticle targeting of anti-cancer drugs that alter intracellular signaling or influence the tumor microenvironment, Adv. Drug Deliv. Rev. (2014), , pp. 1-12.
Seldin, Marcus M. et al., Regulation of tissue crosstalk by skeletal muscle-derived myonectin and other myokines, Adipocyte, 2012, vol. 1, No. 4, pp. 200-202.
Hamrick, Mark W. et al., The skeletal muscle secretome: an emerging player in muscle-bone crosstalk, BoneKEy Reports, 2012, vol. 1, Article No. 60, pp. 1-5.
Compton, J., Nucleic Acid Sequence-Based Amplification, Nature, 1991, vol. 350, No#, pp. 91-92. (Abstract Only).
International Search Report, PCT/US2014/020206, dated May 23, 2014, pp. 1-9.
Kariko, Katalin, et al., Impacts of Nucleoside Modification on RNA-mediated activation of toll-like receptors, 2008, Nucleic Acides in Innate Immunity, No vol., pp. 171-188.
Cystic Fibrosis Transmembrane Conductance Regulator; cystic fibrosis transmembrane conductance regulator [*Homo sapiens*]; NCBI, 2010, No vol., pp. 1-5.
Szabo, E. et al., Direct conversion of human fibroblasts to multilineage blood progenitors. Nature. Nov. 25, 2010; 468(7323): 521-526.
Gonzalez, F. et al., Generation of mouse-induced pluripotent stem cells by transient expression of a single nonviral polycistronic vector. Proc Natl Acad Sci USA. Jun. 2, 2009; 106(22): 8918-8922.
Aasen, T. et al., Efficient and rapid generation of induced pluripotent stem cells from human keratinocytes. Nat Biotechnol. Nov. 2008; 26(11): 1276-1284.
Ebert, A.D. et al., Induced pluripotent stem cells from a spinal muscular atrophy patient. Nature. Jan. 15, 2009; 457(7227): 277-280.o.
Vierbuchen, T. et al., Direct conversion of fibroblasts to functional neurons by defined factors. Nature. Feb. 25, 2010; 463(7284): 1035-1041.
Racila, D. et al., Transient expression of OCT4 is sufficient to allow human keratinocytes to change their differentiation pathway. Gene Ther. Mar. 2011; 18(3): 294-303.
Nakagawa, M. et al., Generation of induced pluripotent stem cells without Myc from mouse and human fibroblasts. Nat Biotechnol. Jan. 2008; 26(1): 101-106. Epub Nov. 30, 2007.

Haft, D.H. et al., A guild of 45 CRISPR-associated (Cas) protein families and multiple CRISPR/Cas subtypes exist in prokaryotic genomes. PLoS Comput Biol. Nov. 2005; 1(6): e60. Epub Nov. 11, 2005.
Brown, C.E., et al., Poly(A) Tail Lengeth Control in *Saccharomyces cerevisiae* Occurs by Message-Specific Deadenylation. Molecular and Cellular Biology, Nov. 1998 p. 6548-6559.
Gao, G., et al., Erythropoietin gene therapy leads to autoimmune anemia in macaques. 2004 103: 3300-3302.
Liu, C., et al., Peptidoglycan Recognition Proteins. A Novel Family of Four Human Innate Immunity Pattern Recognition Molecules. The Journal of Biological Chemistry. vol. 276, No. 37, Issue of Sep. 14, pp. 686-34694, 2001.
Lu, X., Peptidoglycan Recognition Proteins Are a New Class of Human Bactericidal Proteins. The Journal of Biological Chemistry, Mar. 3, 2006, vol. 281, No. 9, pp. 5895-5907.
Ngai, P.H.K., et al. Agrocybin, an antifungal peptide from the edible mushroom. Department of Biochemistry, The Chinese University of Hong Kong. Peptides 26 (2005) 191-196.
Endo, F., et al. A Nonsense Mutation in the 4-Hydroxyphenylpyruvic Acid Dioxygenase Gene (Hpd) Causes Skipping of the Constitutive Exon and Hypertyrosinemia in Mouse Strain III. Genomics 25, 164-169 (1995).
Neve, S., et al. Tissue distribution, intracellular localization and proteolytic processing of rat 4-hydorxyphenylpyruvate dioxygenase. Cell Biology International 27 (2003) pp. 611-624.
Ren, W., et al. Molecular clong and characterization of 4-hydroxyphenylpyruvate dioxygenase gene from Lactuca sativa. Journal of Patent Physiology 168 (2011 pp. 1076-1083).
Ruetschi, U., et al. Human 4-Hydroxyphenylpyruvate Dioxygenase Gene (HPD). Genomics 44, pp. 292-299 (1997).
Seabury, C.M., et al. Analysis of sequence variability and protein domain architectures for bovine peptidoglycan recognition protein 1 and Toll-like receptors 2 and 6. Genomics 92 (2008) pp. 235-245.
Sumathipala, N. et al., Involvement of Manduca sexta peptidoglycan recognition protein-1 in the recognition of bacteria and activation of prophenoloxidase system. Insect Biochemistry and Molecular Biology 40 (2010) 487-495.
Wei, X. et al., Molecular cloning and MRNA expression of two peptidoglycan recognition protein (PGRP genes from mollusk *Solen grandis*. Fish & Shellfish Immunology 32 (2012) 178-185.
Anonymous: "Messenger RNA", Internet: Wikipedia. Jun. 19, 2013, XP002699196, Retrieved from the Internet: URL: http://en.wikipedia.org/wiki/Messenger RNA.
Grosjean, H., DNA and RNA Modification Enzymes Structure, Mechanisms, Functions and Evolution. Molecular Biology Intelligence Unit. Estimated Publication Date: May 2009. pp. 1-2.
Grosjean, H., Nucleic Acids Are Not Boring Long Polymers of Only Four Types of Nucleotides: A Guided Tour. Chapter 1. Landes Bioscience. 2009. pp. 1-18.
Grosjean, H., et al. How Nucleic Acids Cope with High Temperature. Physiology and Biochemistry of Extremophiles. 2007. Chapter 4, pp. 39-58.
Grosjean, H., Modification and editing of RNA: historical overview and important facts to remember. pp. 1-22.
Hunt, D.M., et al., The L Protein of Vesicular Stomatitis Cirus Modulates the Response of the Polyadenylic Acid Polymerase to S-Adenosylhomocysteine. J. gen. Virol. (1988), 69, 2555-2561.
Grosjean, H., et al. Fine-Tuning of RNA Functions by Modification and Editing. Topics in Current Genetics, vol. 12, 2005, XXiV, p. 442.
Bouloy, M., et al., Both the 7-methyl and the 2'-O-methyl groups in the cap of mRNA strongly influence its ability to act as primer for influenza virus RNA transcription. Proc. Natl. Acad. Sci. USA, vol. 77, No. 7, pp. 3952-3956, Jul. 1980.
Fernandez, I., et al. Unusual base pairing during the decoding of a stop codon by the ribosome. vol. 000, 2013. pp. 1-5.
Edelheit, S. et al., Transcriptome-Wide Mapping of 5-methylcytidine RNA Modifications in Bacteria, Archaea, and Yeast Revelas m5C within Archaeal mRNAs. PLOS Genetics, Jun. 2013, vol. 9, Issue 6, pp. 1-14.

(56) References Cited

OTHER PUBLICATIONS

Cun, Dongmei, et al., Preparation and characterization of poly(DL-lactide-co-glycolide) nanoparticles for siRNA delivery. International Journal of Pharmaceutics 390 (2010) 70-75.

Oster, C.G., et al. Comparative study of DNA encapsulation into PLGA microparticles using modified double emulsion methods and spray drying techniques. Journal of Microencapsulation, May 2005; 22(3): 235-244.

GenBank: *Homo sapiens* 15 kDa selenoprotein (Sep. 15), transcript variant 1, mRNA. NCBI Reference Sequence: NM_004261.3, pp. 1-4.

Thomson A. James., et al. Isolation of a primate embryonic stem cell line. vol. 92, pp. 7844-7848, Aug. 1995. Proc. Natl. Acad. Sci. USA.

Tahiliani., et al.Conversion of 5-Methylcytosine to 5-Hydroxymethylcytosine in Mammalian DNA by MLL Partner TET1 Science 324, 930 (2009);www.sciencemag.org.

The Human Embryonic Stem Cell and the Human Embryonic Germ Cell. NIH Stem Cells: Scientific Progress and Future Research Directions, Department of Health and Human Services, Chapter 3, Jun. 2001.

The Stem Cell. NIH Stem Cells: Scientific Progress and Future Research Directions, Department of Health and Human Services, Chapter 1, Jun. 2001.

Morgan D. Hugh, et. al. Molecular Basis of Cell and Developmental Biology:Activation-induced Cytidine Dreaminase Deaminates 5-Methylcytosine in DNA and is Expressed in Pluripotent Tissues: Implications for Epigenetic Reprogramming. J. Biol. Chem. 2004, 279:52353-52360. published online Sep. 24, 2004.

Moore, J.E., et. al. The Corneal Epithelial Stem Cell. vol. 21, Nos. 5/6, 2002. Mary Ann Liebert, Inc. pp. 443-451.

Koh, Peng Kian, et.al. Tet1 and Tet2 Regulate 5-Hydroxymethylcytosine Production and Cell Lineage Specification in Mouse Embryonic Stem Cells. 200-213, Feb. 4, 2011 ª2011 Elsevier Inc.

Kariko, Katalin, et.al. Naturally occurring nucleoside modifications suppress the immunostimulatory activity of RNA: Implication for therapeutic RNA development. Current Opinion in Drug Discovery & Development 2007 10(5) 523-532 The Thomson Corporation ISSN 1367-6733.

Ito, Shinsuke, et.al. Role of Tet proteins in 5mC to 5hmC conversion, ES-cell self-renewal and inner cell mass specification. vol. 466|Aug. 26, 2010| Macmillan Publishers Limited. pp. 1129-1133.

Freudenberg, M. Johannes, et.al. Acute depletion of Tet1-dependent 5-hydroxymethylcytosine levels impairs LIF/Stat3 signaling and results in loss of embryonic stem cell identity. Published online Dec. 30, 2011. 3364-3377 Nucleic Acids Research, 2012, vol. 40, No. 8.Published by Oxford University Press 2011.

Ficz, Gabriella, et.al. Dynamic regulation of 5-hydroxymethylcytosine in mouse ES cells and during differentiation. Nature | vol. 4 7 3 | May 19, 2011. pp. 398-401. Macmillian Publishers.

Blelloch, Robert, et.al. Generation of Induced Pluripotent Stem Cells in the Absence of Drug Selection. Sep. 13, 2007. pp. 245-247.

Verma, Sandeep, et.al. Modified Oligonucleotides: Synthesis and Strategy for Users. Biochem. 1998. 67:99-134. 1998 by Annual Reviews.

Leung W. David. The Structure and Functions of Human Lysophosphatidic Acid Acyltransferases. Frontiers in Bioscience 6. pp. 944-953, Aug. 1, 2001.

Lu, Biao, et.al. Cloning and characterization of murine 1-acyl-sn-glycerol 3-phosphate acyltransferases and their regulation by PPAR in murine heart. Biochem J. (2005) 385, 469-477 (printed in Great Britain).

West, James, et.al. Cloning and Expression of Two Human Lysophosphatidic Acid Acyltransferase cDNAs That Enhance Cytokine-Induced Signlaing Responses in Cells. DNA and Cell Biology vol. 16, Nov. 6, 1997. Mary Ann Liebert, Inc. pp. 691-791.

Bionaz, Massimo, et.al. ACSL1, AGPAT6, FABP3, LPIN1, and SLC27A6 are the Most Abundant Isoforms in Bovine Mammary Tissue and Their Expression is Affected by Stage of Lactation. The Journal of Nutrition, 2008. pp. 1019-2024.

Egeter, O. et al., Eradication of disseminated lymphomas with CpG-DNA activated T helper type 1 cells from nontransgenic mice. Cancer Res. Mar. 15, 2000;60(6):1515-20.

El Ouahabi, A., et al., Double long-chain amidine liposome-mediated self replicating RNA transfection. FEBS Letters. Feb. 1996; 380(1-2): 108-112.

Elango, N., et al., Optimized transfection of mRNA transcribed from a d(A/T)100 tail-containing vector. Biochem Biophys Res Commun. 2005; 330: 958-966.

Elbashir, S.M. et al., Duplexes of 21-nucleotide RNAs mediate RNA interference in cultured mammalian cells. Nature. May 24, 2001;411(6836):494-8.

Ellem, K.A.O., and Colter, J.S. The isolation of three variants of mengo virus differing in plaque morphology and hemagglutinating characteristics. Virology. Nov. 1961; 15(3): 340-347.

Ellem, K.A.O., and Colter, J.S. The interaction of infectious ribonucleic acid with a mammalian cell line: I. Relationship between the osmotic pressure of the medium and the production of infectious centers. Virology. Jun. 1960; 11(2): 434-443.

Ellem, K.A.O. and Colter, J.S. The interaction of infectious ribonucleic acid with a mammalian cell line: II. Kinetics of the formation of infectious centers. Virology. Dec. 1960; 12(4): 511-520.

Ellem, K.A.O. and Colter, J.S. The interaction of infectious ribonucleic acids with mammalian cells: III. Comparison of infection and RNA uptake in the HeLa cell-polio RNA and L cell-mengo RNA systems. Virology. Oct. 1961; 15(2): 113-126.

Epicentre Forum. Tools and Techniques for Genomics and RNA Research. 2006; 13(2): 1-8.

Epicentre Forum. Tools and Techniques for Genomics and RNA Research. 2007; 14(1): 1-24.

Esposito, S., Effect on Leukaemic Cells of Ribonucleic Acid Extracted from Calf's Spleen. Nature. Sep. 1964; 203: 1078-1079.

Esvelt, K., et al., A system for the continuous directed evolution of biomolecules. Nature. Apr. 2011; 472(7344): 499-503.

Fahy, E. et al., Self-sustained sequence replication (3SR): an iso-thermal transcription-based amplification system alternative to PCR. PCR Methods Appl. Aug. 1991;1(1):25-33.

Faissner, A. et al., Analysis of polypeptides of the tree shrew (*Tupaia*) herpesvirus by gel electrophoresis. J Gen Virol. Jan. 1982;58 Pt 1:139-48.

Fan, X.C., et al., Overexpression of HuR, a nuclear-cytoplasmic shuttling protein, increases the in vivo stability of ARE-containing mRNAs. Embo J. 1998; 17(12): 3448-3460.

Fandrich, F. et al., Preimplantation-stage stem cells induce long term allogeneic graft acceptance without supplementary host conditioning. Nat Med. Feb. 2002;8(2):171-8.

Fang, S.H. et al., Functional measurement of hepatitis C virus core-specific CD8(+) T-cell responses in the livers or peripheral blood of patients by using autologous peripheral blood mononuclear cells as targets or stimulators. J Clin Microbiol. Nov. 2001;39(11):3895-901.

Fearnley, D.B. et al., Monitoring human blood dendritic cell numbers in normal individuals and in stem cell transplantation. Blood. Jan. 15, 1999;93(2):728-36.

Felgner, P.L., et al., Lipofection: a highly efficient, lipid-mediated DNA-transfection procedure. Proc Natl Acad Sci U S A. Nov. 1987;84(21):7413-7.

Felgner, P.L. Particulate systems and polymers for in vitro and in vivo delivery of polynucleotides. Adv. Drug Delivery Rev. 1990; 5(3): 163-187.

Felgner, P.L. Cationic lipid/polynucleotide condensates for in vitro and in vivo polynucleotide delivery—the cytofectins. J. of Liposome Research. 1993; 3(1): 3-16.

Fisch, P. et al., Generation of antigen-presenting cells for soluble protein antigens ex vivo from peripheral blood CD34+ hematopoietic progenitor cells in cancer patients. Eur J Immunol. Mar. 1996;26(3):595-600.

Fisher, K.J. and Wilson, J.M. The transmembrane domain of diphtheria toxin improves molecular conjugate gene transfer. Biochem. J. Jan. 1997; 321(1): 49-58.

(56) References Cited

OTHER PUBLICATIONS

Fishman, M., et al., In vitro transfer of macrophage RNA to lymph node cells. Nature. May 11, 1963;198:549-51.
Fisk, B. et al., Identification of an immunodominant peptide of HER-2/neu protooncogene recognized by ovarian tumor-specific cytotoxic T lymphocyte lines. J Exp Med. Jun. 1, 1995;181(6):2109-17.
Frank, B. et al., Interanimal "memory" transfer: results from brain and liver homogenates. Science. Jul. 24, 1970;169(3943):399-402.
Franklin, R.M., Purification and properties of the replicative intermediate of the RNA bacteriophage R17. Proc Natl Acad Sci U S A. Jun. 1966;55(6):1504-11.
Frey, M.R. et al., RNA-mediated interaction of Cajal bodies and U2 snRNA genes. J Cell Biol. Aug. 6, 2001;154(3):499-509.
Fukuda, I. et al., In vitro evolution of single-chain antibodies using mRNA display. Nucleic Acids Res. 2006;34(19): e127. Epub Sep. 29, 2006.
Fusaki, N., et al., Efficient induction of transgene-free human pluripotent stem cells using a vector based on Sendai virus, an RNA virus that does not integrate into the host genome. Proc Jpn Acad Ser B Phys Biol Sci. 2009; 85(8): 348-362.
Fynan E.F. et al., DNA vaccines: protective immunizations by parenteral, mucosal, and gene-gun inoculations. Proc Natl Acad Sci U S A. Dec. 15, 1993;90(24):11478-82.
Gall, J.G. et al., A role for Cajal bodies in assembly of the nuclear transcription machinery. FEBS Lett. Jun. 8, 2001;498(2-3):164-7.
Gall, J.G. The centennial of the Cajal body. Nat Rev Mol Cell Biol. Dec. 2003;4(12):975-80.
Gallie, D.R., A tale of two termini: a functional interaction between the termini of an mRNA is a prerequisite for efficient translation initiation. Gene. Aug. 17, 1998;216(1):1-11.
Gallie, D.R., The cap and poly(A) tail function synergistically to regulate mRNA translational efficiency. Genes Dev. Nov. 1991;5(11):2108-16.
Ganot, P. et al., Site-specific pseudouridine formation in preribosomal RNA is guided by small nucleolar RNAs. Cell. May 30, 1997;89(5):799-809.
Gao, M. et al., A novel mRNA-decapping activity in HeLa cytoplasmic extracts is regulated by AU-rich elements. EMBO J. Mar. 1, 2001;20(5):1134-43.
Gao, X. et al., Nonviral gene delivery: what we know and what is next. AAPS J. Mar. 23, 2007;9(1):E92-104.
Garbe, C. et al., [Epidemiology of malignant melanoma in West Germany in an international comparison]. Onkologie. Dec. 1989;12(6):253-62.
Gardiner-Garden, M. et al., CpG islands in vertebrate genomes. J Mol Biol. Jul. 20, 1987;196(2):261-82.
Gasche, C. et al., Sequential treatment of anemia in ulcerative colitis with intravenous iron and erythropoietin. Digestion. 1999;60(3):262-7.
GenBank NP_000651.3, Transforming growth factor beta-1 precursor [*Homo sapiens*]. Nov. 13, 2011; online.
Gerbi, S.A. et al., All small nuclear RNAs (snRNAs) of the [U4/U6.U5] Tri-snRNP localize to nucleoli; Identification of the nucleolar localization element of U6 snRNA. Mol Biol Cell. Sep. 2002;13(9):3123-37.
Gershon, P.D., (A)-tail of two polymerase structures. Nat Struct Biol. Oct. 2000;7(10):819-21.
Gierer, A and Schramm, G. Infectivity of ribonucleic acid from tobacco mosaic viurs. Nature. Apr. 1956; 177(4511): 702-703.
Gilboa, E. et al., Cancer immunotherapy with mRNA-transfected dendritic cells. Immunol Rev. Jun. 2004;199:251-63.
Giljohann, D.A., et al., Gene regulation with polyvalent siRNA-nanoparticle conjugates. J Am Chem Soc. Feb. 2009; 131(6): 2072-2073.
Gilkeson, G.S. et al., Induction of cross-reactive anti-dsDNA antibodies in preautoimmune NZB/NZW mice by immunization with bacterial DNA. J Clin Invest. Mar. 1995;95(3):1398-402.

Ginsberg, S.D. et al., Expression profile of transcripts in Alzheimer's disease tangle-bearing CA1 neurons. Ann Neurol. Jul. 2000;48(1):77-87.
Ginsberg, S.D. et al., Predominance of neuronal mRNAs in individual Alzheimer's disease senile plaques. Ann Neurol. Feb. 1999;45(2):174-81.
Agadjanyan, M., Prototype Alzheimer's Disease Vaccine Using the Immunodominany B Cell Type from β-Amloid and Promiscuous T Cell Epitope Pan HLA DR-Binding Peptide, J Immunol, 2005, vol. 174, no number, pp. 1580-1586.
Cribbs, David H., Adjuvant-dependent Modulation of Th1 and Th2 Responses to Immunization with β-amyloid, International Immunology, vol. 15, No. 4, pp. 505-514.
Davtyan, H. et al., Immunogenicity, Efficacy, Safety, and Mechanism of Action of Epitope Vaccine (Lu AF20513) for Alzheimer's Disease: Prelude to a Clinical Trial, The Journal of Neuroscience, Mar. 2013, vol. 33, No. 11, pp. 4923-4934.
Zwick, M. et al., Identification and Characterization of a Peptide That Specifically Binds the Human, Broadly Neutralizing Anti-Human Immunodeficiency Virus Type 1 Antibody b12, Journal of Virology, Jul. 2001, vol. 75, No. 14, pp. 6692-6699.
Zwick, M. et al., Molecular Features of the Broadly Neutralizing Immunoglobulin G1, b12 Required for Recognition of Human Immunodeficiency Virus Type 1 gp120, Journal of Virology, 2003, vol. 77, No. 10, pp. 5863-5876.
Wilkinson, R. et al., Structure of the Fab Fragment of F105, a Broadly Reactive Anti-Human Immunodeficiency Virus (HIV) Antibody that Recognizes the CD4 Binding Site of HIV type 1 gp120, Journal of Virology, 2005, vol. 79, No. 20, pp. 13060-13069.
Julien, Jean-Philippe et al., Broadly Neutralizing Antibody PGT121 Allosterically Modulates CD4 Binding via Recognition of the HIV-1 gp120 V3 Base and Multiple Surrounding Glycans, PLOS Pathogens, 2013, vol. 9, Issue 5, pp. 1-15.
Laursen, N. et al., Broadly Neutralizing Antibodies Against Influenza Viruses, Antiviral Research, 2013, vol. 98, no number, pp. 476-483.
Barouch, Dan et al., Therapeutic Efficacy of Potent Neutralizing HIV-1-specific monoclonal Antibodies in SHIV-infected Rehesus Monkeys, Nature, 2013, vol. 503, No. 7475, pp. 224-228.
Shingai, M. et al., Antibody-mediated Immunotherapy of Macaques Chronically Infected with SHIV Suppresses Viraemia, Nature, 2013, vol. 503, No. 7475, pp. 277-280.
Balaza, Alejandro et al., Vectored Immunoprophylaxis Protects Humanized Mice from Mucosal HIV Transmission, Nature Medicine, 2014, vol. 3, pp. 296-300.
Burton, Dennis et al., A Large Array of Human Monoclonal Antibodies to Type 1 Human Immunodefiency Virus From Combinatorial Libraries of Asymptomatic Seropositive Individuals, Proc. Natl Acad., USA,1991, vol. 88, No Number, pp. 10134-10137.
Burton, Dennis et al., Efficient Neutralization of Primary Isolates of HIV-1 by a Recombinant Human Monoclonal Antibody, Science, 1994, vol. 266, No Number, pp. 1024-1027.
Scheid, Johannes et al., Sequence and Structural Convergence of Broad and Potent HIV Antibodies That Mimic CD4 Binding, Science , 2011, vol. 333, No Number, 1633-1637.
Ledford, H., Supercharged Antibodies Fight HIV-Related Virus in Monkeys, Nature, 2013, No Volume, pp. 1-2.
Delehanty, James B., Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.
Dharap, S.S., et al., Tumor-specific Targeting of an Anticancer Drug Delivery System by LHRH Peptide, PNAS, 2005, vol. 102, No. 36, pp. 12962-12967.
Du, L. et al., Arginine-rich cell-penetrating peptide dramatically enhances AMO-mediated ATM Aberrant Splicing Correction and Enables Delivery to Brain and Cerebellum, Human Molecular Genetics, 2011, vol. 20, No. 16, pp. 3151-3160.
Ezzat, Kariem et al. PepFect 14, a Novel Cell-penetrating Peptide for Oligonucleotide Deliver in Solution and as Solid Formulation, Nucleic Acids Research, 2011, vol. 39, No. 12, pp. 5284-5298.

(56) References Cited

OTHER PUBLICATIONS

Fang, Shun-lung et al., A Novel Cell-Penetrating Peptide Derived from Human Eosinophil Cationic Protein, PLOS One, 2013, vol. 8, Issue 3, pp. 1-13.
Giblin, M. et al., Selective Targeting of *E. coli* Heat-stable Enterotoxin Analogs to Human Colon Cancer Cells, Anticancer Research, 2006,vol. 26, No number, pp. 3243-3252.
Kelly, Kimberley et al. , Isolation of a Colon Tumor Specific Binding Peptide Using Phage Display Selection, Neoplasia, 2003, vol. 5, No. 5, pp. 437-444.
Knowles, Lynn et al., CLT1 Targets Angiogenic Endothelium through CLIC1 and Fibronectin, Angiogenesis, 2012, vol. 15, No. 1, pp. 115-129.
Laakkonen, Pirjo et al., Homing Peptides as Targeted Delivery Vehicles, Interactive Biology , 2010, vol. 2, No number, pp. 326-337.
Li, Zhi Jie, et al., Peptides as Targeting Probes Against Tumor Vasculature for Diagnosis and Drug Delivery, Journal of Translational Medicine, 2012, vol. 10 , Supp 1, No. s1, pp. 1-9.
Lin, Jieru et al., Bacterial Heat-Stable Enterotoxins: Translation of Pathogenic Peptides into Novel Targeted Diagnostics and Therapeutics, Toxins, 2010, vol. 2, No number, pp. 2028-2054.
Lo, Albert et al., Hepatocellular Carcinoma Cell-Specific Peptide Ligand for Targeted Drug Delivery, Molecular Cancer Therapeutics, 2008, vol. 7 , No. 3, pp. 579-589.
Lu, Ruei-Min et al., Targeted Drug Delivery Systems Mediated by a Novel Peptide in Breast Cancer Therapy and Imaging, PLOS One, 2013, vol. 8, Issue 6, pp. 1-13.
Pangburn, Todd et al., Peptide-and Aptamer-Functionalized Nanovectors for Targeted Delivery of Therapeutics, Journal of Biomedical Engineering, 2009, vol. 131, No number, pp. 1-20.
Phelan, Anne et al., Intercellular Delivery of Functional p53 by the Herpesvirus Protein VP22, Nature Biotechnology , 1998, vol. 16, pp. 440-443.
Laakkonen, Pirjo et al., Homing Peptides as Targeted Delivery Vehicles, Integrative Biology, 2010, vol. 2, no number, pp. 326-337.
Regberg, Jakob et al., Applications of Cell-Penetrating Peptides for Tumor Targeting and Future Cancer Therapies, Pharmaceuticals, 2012, vol. 5, No number, pp. 991-1007.
Suchanek, Gerda et al., Amino Acid Sequence of Honeybee Prepromelittin Synthesized in Vitro, Proc. Natl. Acad. Sci. USA,1978, vol. 75, No. 2, pp. 701-704.
Torchilin, Vladimir et al., Multifunctional and Stimuli-Sensitive Pharmaceutical Nanocarriers, Eur J. Pharm Biopharm, 2009, vol. 71, No. 3, pp. 431-444.
Yang, Xiaoming, et al., Effect of CD44 Binding Peptide Conjugated to an Engineered Inert Matrix on Maintenance of Breast Cancer Stem Cells and Tumorsphere Formation, PLOS One, 2013, vol. 8, Issue 3, pp. 1-15.
Zou, Li-li et al., Cell-Penetrating Peptide-Mediated Therapeutic Molecule Delivery Into the Central Nervous System, Current Neuropharmacology, 2013, vol. 11, No. 2, pp. 197-208.
Baars, A. et al., A Phase II Study of Active Specific Immunotherapy and 5-FU/Leucovorin as Adjuvant Therapy for Stage III Colon Carcinoma, British Journal of Cancer, 2002, vol. 86, No. 8, pp. 1230-1234.
Badawi, Ahmed, et al. , Immune Modulating Peptide for the Treatment and Suppression of Multiple Sclerosis, Clin Immunol, 2012, vol. 144, No. 2, pp. 127-138.
Bandala-Sanchez, Esther et al., T cell Regulation Mediated by Interaction of Soluble CD52 with the Inhibitory Receptor Siglec-10, Nature Immunology, 2013, vol. 14, No. 7, pp. 741-751.
Lu, Changming et al., miR-221 and miR-155 Regulate Human Dendritic Cell Development Apoptosis, and IL-12 Production Through Targeting of p27kip1, KPC1 and SOCS-1, BLOOD, 2011, vol. 117, No. 16, pp. 4293-4303.
Chang, C et al., Tolerization of Dendritic Cells by Ts cells: The Crucial Role of Inhibitory Receptors ILT3 and ILT4, Nature Immunology, 2002, vol. 3, No. 3, pp. 237-243.
Cheng, Guotan et al., T Cell Tolerance and the Multi-Functional Role of IL-2R Signalling in T Regulatory Cells, Immunol Rev., 2011, vol. 241, No. 1, pp. 63-76.
Cools, Nathalie, et al., Balancing Between Immunity and Tolerance: an Interplay Between Dendritic Cells, Regulatory T Cells, and Effector T Cells, Journal of Leukocyte Biology, 2007, vol. 82, pp. 1365-1374.
Cousens, Leslie et al., Tregitope Update: Mechanism of Action Parallels IVIg, Autoimmunity Reviews, 2012, No Volume, pp. 1-8.
Cousens, L. et al., In Vitro and In Vitro Studies of IgC-derived Treg Epitopes (Tregitopes): A Promising New Tool for Tolerance Induction and Treatment of Autoimmunity, J. Clin. Immunol, 2013, vol. 33, Supp 1, pp. 43-49.
Cousens, Leslie et al., Application of IgC-Derived Natural Treg Epitopes (IgG Tregitopes) to Antigen-Specific Tolerance Induction in a Murine Model of Type 1 Diabetes, Journal of Diabetes, vol. 2013, Article ID 621693, pp. 1-17.
Danke, Nancy et al., Comparative Study of GAD65-specific CD4+ T cells in healthy and Type 1 Diabetic Subjects, Journal of AutoImmunity, 2005, vol. 25, No Number, 303-311.
DeGroot, Anne S. et al., Activation of Natural Regulatory T cells by IgG F-derived peptide "Tregitopes", 2008, vol. 112, No. 8, pp. 3303-3311.
DiCaro, Valentina, et al., In Vivo Delivery of Nucleic Acid-Formulated Microparticles as a Potential Tolerogenic Vaccine for Type 1 Diabetes, 2012, vol. 9, No. 4, pp. 348-356.
EMEA, Committee for Medicinal Products for Human Use, European Medicines Agency, 2008, No vol. pp. 1-13.
Trollet et al., Delivery of DNA into muscle for treating systemic diseases: advantages and challenges. Methods Mol. Biol. 2008., 423: 199-214.
International Search Report from International Application No. PCT/US12/38028 dated Aug. 14, 2012.
Lorenzi, J.C., et al., Protein expression from exogenous mRNA: Uptake by receptor-mediated endocytosis and trafficking via the lysosomal pathway. RNA Biology, vol. 8, No. 4, Jul. 1, 2011, pp. 252-258.
International Search Report from International Application No. PCT/US13/54635 dated Mar. 3, 2014.
International Search Report from International Application No. PCT/US13/030070 dated Dec. 23, 2013.
Kassim et al., Gene Therapy in a humanized Mouse Model of Familial Hypercholesterolemia Leads to a Marked Regression of Atherosclerosis, PLOS ONE, Oct. 2010, vol. 5, Issue 10, pp. e13424.
Supplementary Data from Zhang et al., (J. Biol. Chem 282(25) 18602-12, 2007.
International Search Report from International Application No. PCT/US12/054574 dated Jul. 1, 2013.
NCBI BLAST (hyyp://blast.ncbi.nim.nih.gov/Blast.cgi;accession No. BE136127, 2007.
Bell et al., Predisposition to Cancer Caused by Genetic and Functional Defects of Mammalian Atad5, PLOS Genetics, Aug. 2011, vol. 7, Issue 8, e1002245 pp. 1-15.
Gupta et al., Project Report Condon Opitimization, 2003, pp. 1-13.
Whiteside, George, The Orgins and the future of microfluidics, Nautre, vol. 442, Jul. 27, 2006 pp. 368-373.
Pridgen, et al.; Transepithelial Transport of Fc-Targeted Nanoparticles by the Neonatal Fc Receptor for Oral Delivery, Sci Translation Med., vol. 5, Issue 213, Nov. 27, 2013, pp. 1-8.
Nguyen, M. et al., Injectable Biodergradable Hydrogels, Macromolecular Bioscience, 2010,10, 563-579.
Morton, S. Scalable Manufacture of Built-to-Order Nanomedicine: Spray-Assisted Layer-by-Layer Functionalization of Print Nanoparticles, Advanced Materials, 2013, 25, 4708-4712.
Li, Z et al., Controlled Gene Delivery System Based pn Thermosensitive Biodegradeable Hydrogel, Pharmaceutical Research, vol. 20, No. 6, Jun. 2003.
Lee, et al.; Thermosensitive Hydrogel as a Tgf-β 1 Gene Delivery Vehicle Enhances Diabetic Wound Healing, Pharmaceutical Research, vol. 20, No. 12, Dec. 2003.

(56) References Cited

OTHER PUBLICATIONS

Cu, Y. et al., Enhanced Delivery and Potency of Self-Amplifying mRNA Caccines by Electroporation in Situ, Vaccines, 2013, 1, 367-383.

Chang, C. et al., Non-ionic amphiphilic biodegradable PEG-PLGA-PEG copolymer enhances gene delivery efficiency in rat skeletal muscle; Science Direct, Journal of Controlled Release 118 (2007) 245-253.

Nelson, C. et al., Tunable Delivery of SiRNA from a Biodergradable Scaffold to Promote Angiogenesis In Vivo, Advanced Materials, 2013, pp. 1-8.

Stroock, A. et al., Chaotic Mixer for Microchannels, Science, vol. 295, Jan. 25, 2002, pp. 1-6.

Zangi, L. et al., Modified mRNA directs the fate of heart progenitor cells and indices vasuclar regeneration after myocardial infarction, Nature Biology, Advanced Online Publication, May 10, 2013, pp. 1-9.

Valencia, P. et al. Micoriluidic Platform for Combinatorial Synthesis and Optimization of Targeted Nanoparticles for Cancer Therapy, ACS Nano. Dec. 23, 2013; 7(12):10671-80.

Chen, Y., Self-assembled rosette nanotubes encapsulate and slowly release dexamethasone, International Journal of Nanomedicine, 2011:6 pp. 1035-1044.

Mitragotri, S.; Devices for Overcoming Biological Barriers: The use of physical forces to disrupt the barriers, Advance Drug Delivery Reviews, 65 (2013)100-103.

Wang, X.; Re-evaluating the Roles of Proposed Modulators of Mammalian Target of Rapamycin Complex 1 (mTORCI) Signaling,The Journal of Biological Chemisty, Nov. 7, 2008, vol. 283, No. 45, pp. 30482-30492.

Dreyer Hans C., Leucine-enriched essential amino acid and carbohydrate ingestion following resistance exercise ehances mTOR signaling and protien synthesis in human muscle, AM J. Physiol Endocrinol Metab,; 294; E392-E400,2008.

Lalatsa, Aikaterini, Amphiphilic poly (l-amino acids)—New materials for drug delivery, Journal of Controlled Release, 161 (2012) 523-536.

Stelic Institute & Co., Contract Research Services Specialized in NASH-HCC, Ver.2012.11, 2012, 99.1-10.

Limberis, M et al., Intranasal Antibody Gene Transfer in Mice and Ferrets Elicits Broad Protection Against Pandemic Influenza, Science Transl Med vol. 5, Issue 187, 99. 1-8.

Wei, et al. Induction of Broadly Neutralizing H1N1 Influenza Antibodies by Vaccination, Science vol. 329, (2010) pp. 1060-1064.

Palese, P., Making Better Influenza Virus Vaccines?, Emerging Infectious Diseases, vol. 12, No. 1 Jan. 2006, pp. 61-65.

Kwong, P. et al., Broadly Neutralizing Antibodies and the Search for an HIV-1 Vaccine: The End of the Beginning, Nature Reviews, Immumology, vol. 13, Sep. 2013, pp. 693-701.

DeMarco, et al., A Non-VH1-69 Hetetrosubtypic Neutirlizing Human Minoclonal Antibody Protects Mice Against H1N1 and H5N1 Viruses, PLOS One, Apr. 2012, vol. 7, Issue 4, pp. 1-9.

Anderson, et al. The Bridge, National Academy of Engineering of the National Academies, Fall 2006, vol. 36., No. 3, pp. 1-55.

EP11830061, Supplementary Search Report, Mar. 18, 2014.

Abuchowski, A. et al., Immunosuppressive properties and circulating life of Achromobacter glutaminase-asparaginase covalently attached to polyethylene glycol in man. Cancer Treat Rep. Nov.-Dec. 1981;65(11-12):1077-81.

Abuchowski, A. et al., Reduction of plasma urate levels in the cockerel with polyethylene glycol-uricase. J Pharmacol Exp Ther. Nov. 1981;219(2):352-4.

Aduri, R., et al., AMBER force field parameters for the naturally occurring modified nucleosides in RNA. J Chem Theory Comput. 2007; 3: 1464-1475.

Agaisse, H. et al., STAB-SD: a Shine-Dalgarno sequence in the 5' untranslated region is a determinant of mRNA stability. Mol Microbiol. May 1996;20(3):633-43.

Aissani, B. et al., CpG islands, genes and isochores in the genomes of vertebrates. Gene. Oct. 15, 1991;106(2):185-95.

Akashi, H., Gene expression and molecular evolution. Curr Opin Genet Dev. Dec. 2001;11(6):660-666.

Aksenova, N.N. et al., Influence of ribonucleic acids from the liver on implantation and growth of transplantable tumours. Nature. Nov. 3, 1962;196:443-4.

Alberts, et al., Molecular Biology of the Cell, 3rd ed. Garland Publishing, Inc. New York, NY, 1994, pp. 368-369.

Aleku, M., et al., Atu027, a liposomal small interfering RNA formulation targeting protein kinase N3, inhibits cancer progression. Cancer Res. 2008; 68: 9788-9798.

Anderson, B.R., et al., Nucleoside modifications in RNA limit activation of 2'-5'-oligoadenylate synthetase and increase resistance to cleavage by Rnase L. Nucleic Acids Res. 2011; 1-10.

Anderson, D.M. et al., Stability of mRNA/cationic lipid lipoplexes in human and rat cerebrospinal fluid: methods and evidence for nonviral mRNA gene delivery to the central nervous system. Hum Gene Ther. Feb. 10, 2003;14(3):191-202.

Andrews-Pfannkoch, C. et al., Hydroxyapatite-mediated separation of double-stranded DNA, single-stranded DNA, and RNA genomes from natural viral assemblages. pl Environ Microbiol. Aug. 2010;76(15):5039-45. Epub Jun. 11, 2010.

Andries, O., et al., Comparison of the gene transfer efficiency of mRNA/GL67 and pDNA/GL67 complexes in respiratory cells. Mol Pharmaceutics. 2012; 9: 2136-2145.

Anichini, A. et al., Cytotoxic T cells directed to tumor antigens not expressed on normal melanocytes dominate HLA-A2.1-restricted immune repertoire to melanoma. J Immunol. Jan. 1, 1996;156(1):208-17.

Aota, S. et al., Diversity in G + C content at the third position of codons in vertebrate genes and its cause. Nucleic Acids Res. Aug. 26, 1986;14(16):6345-55.

Apostolopoulos, V. et al., Cellular mucins: targets for immunotherapy. Crit Rev Immunol. 1994;14(3-4):293-309.

Archer, S.J., Induction of a T-cell specific antigen on bone marrow lymphocytes with thymus RNA. Immunology. Jan. 1978;34(1):123-9.

Ashley, D.M. et al., Bone marrow-generated dendritic cells pulsed with tumor extracts or tumor RNA induce antitumor immunity against central nervous system tumors. J Exp Med. Oct. 6, 1997;186(7):1177-82.

Ast, G., How did alternative splicing evolve? Nat Rev Genet. Oct. 2004;5(10):773-82.

Aurup, H. et al., Translation of 2'-modified mRNA in vitro and in vivo. Nucleic Acids Res. Nov. 25, 1994;22(23):4963-8.

Austyn, J.M. et al., New insights into the mobilization and phagocytic activity of dendritic cells. J Exp Med. Apr. 1, 1996;183(4):1287-92.

Babich, F.R. et al., Cross-species transfer of learning: effect of ribonucleic acid from hamsters on rat behavior. Proc Natl Acad Sci U S A. Nov. 1965;54(5):1299-302.

Bachellerie, J.P. et al., Antisense snoRNAs: a family of nucleolar RNAs with long complementarities to rRNA. Trends Biochem Sci. Jul. 1995;20(7):261-4.

Bag, J., Recovery of normal protein synthesis in heat-shocked chicken myotubes by liposome-mediated transfer of mRNAs. Can. J. Biochem. Cell Biol. 1985; 63(3): 231-235.

Bagnall, et al., Rat strain differences on performance in the Morris water maze. Animal Technology, 1999, 50(2):69-77.

Baker, D.L. et al., RNA-guided RNA modification: functional organization of the archaeal H/ACA RNP. Genes Dev. May 15, 2005;19(10):1238-48. Epub May 3, 2005.

Bakker, J.M. et al, Therapeutic antibody gene transfer: an active approach to passive immunity. Mol Ther. Sep. 2004;10(3):411-6.

Balakin, A.G. et al., The RNA world of the nucleolus: two major families of small RNAs defined by different box elements with related functions. Cell. Sep. 6, 1996;86(5):823-34.

Bandbon Balenga, N.A. et al., Bicistronic expression plasmid encoding allergen and anti-IgE single chain variable fragment antibody as a novel DNA vaccine for allergy therapy and prevention. Med Hypotheses. 2006;67(1):71-4. Epub Mar. 2, 2006.

Banerjee, A.K., 5'-terminal cap structure in eucaryotic messenger ribonucleic acids. Microbiol Rev. Jun. 1980;44(2):175-205.

(56) References Cited

OTHER PUBLICATIONS

Barber, R., The chromatographic separation of ribonucleic acids. Biochim Biophys Acta. Feb. 21, 1966;114(2):422-4.
Bargmann, C.I. et al., The neu oncogene encodes an epidermal growth factor receptor-related protein. Nature. Jan. 16-22, 1986;319(6050):226-30.
Barlow, P.G., et al., The human cathelicidin LL-37 preferentially promotes apoptosis of infected airway epithelium. Am J Respir Cell Mol Biol. Dec. 2010; 43(6): 692-702.
Basarkar, A. et al., Nanoparticulate systems for polynucleotide delivery. Int J Nanomedicine. 2007; 2(3): 353-360.
Basha, G, et al., Influence of cationic lipid composition on gene silencing properties of lipid nanoparticle formulations of siRNA in antigen-presenting cells. Mol Ther. Dec. 2011; 19(12): 2186-2200.
Bechler, K., Influence of capping and polyadenylation on mRNA expression and on antisense RNA mediated inhibition of gene expression. Biochem Biophys Res Commun. Dec. 8, 1997;241(1):193-9.
Beljanski, et al., Iron stimulated RNA-dependent DNA polymerase activity from goldfish eggs. Cell Mol Biol. 1988;34(1):17-25.
Belliveau, N.M., et al., Microfluidic synthesis of highly potent limit-size lipid nanoparticles for in vivo delivery of siRNA. Mol Ther Nucleic Acids. Aug. 2012; 1(8): e37.
Bernardi, G. et al., The vertebrate genome: isochores and evolution. Mol Biol Evol. Jan. 1993;10(1):186-204.
Bernhard, H. et al., Generation of immunostimulatory dendritic cells from human CD34+ hematopoietic progenitor cells of the bone marrow and peripheral blood. Cancer Res. Mar. 1, 1995;55(5):1099-104.
Bernstein, E. et al., Role for a bidentate ribonuclease in the initiation step of RNA interference. Nature. Jan. 18, 2001;409(6818):363-6.
Bernstein, P. et al., Poly(A), poly(A) binding protein and the regulation of mRNA stability. Trends Biochem Sci. Sep. 1989;14(9):373-7.
Bertolini, M.C., et al., Fractionation of immune RNA isolated from the spleens of mice infected with Trypanosoma cruz. J Infect Dis. Jun. 1981;143(6):827-31.
Bertolini, In vitro effect of 18S immune RNA on macrophage resistance to Trypanosoma cruzi. Cell Mol Biol. 1986;32(2):167-71.
Bertolini, The protective effect of the 4-5S immune RNA against Trypanosoma cruzi infection in mice. Trop Med Parasitol. Sep. 1985;36(3):131-4.
Bertrand, E. et al., Assembly and traffic of small nuclear RNPs. Prog Mol Subcell Biol. 2004;35:79-97.
Bettinger, T. et al., Peptide-mediated RNA delivery: a novel approach for enhanced transfection of primary and post-mitotic cells. Nucleic Acids Res. Sep. 15, 2001;29(18):3882-91.
Bevan, M.J. et al., Antigen presentation to cytotoxic T lymphocytes in vivo. J Exp Med. Sep. 1, 1995;182(3):639-41.
Bevilacqua, A. et al., Post-transcriptional regulation of gene expression by degradation of messenger RNAs. J Cell Physiol. Jun. 2003;195(3):356-72.
Bieler, K. et al., Plasmids for Therapy and Vaccination. Wiley-VCH GmbH, Weinheim, Feb. 2001.
Goldberg, I.H. et al., The incorporation of 5-ribosyluracil triphosphate into RNA in nuclear extracts of mammalian cells. Biochemical Biophysical Research Communications. 1961; 6(5): 394-398.
Goldberg, I.H. et al., Comparative utilization of pseudouridine triphosphate and uridine triphosphate by ribonucleic acid polymerase. J Biological Chem. May 1963; 238(5): 1793-1800.
Gordon, S.N. et al., Targeting the vaginal mucosa with human papillomavirus pseudovirion vaccines delivering SIV DNA. J Immunol. Jan. 15, 2012; 188(2): 714-723.
Grabbe, S. et al., Dendritic cells as initiators of tumor immune responses: a possible strategy for tumor immunotherapy? Immunol Today. Mar. 1995;16(3):117-21.
Grabbe, S. et al., Tumor antigen presentation by epidermal antigen-presenting cells in the mouse: modulation by granulocyte-macrophage colony-stimulating factor, tumor necrosis factor alpha, and ultraviolet radiation. J Leukoc Biol. Aug. 1992;52(2):209-17.
Grabbe, S. et al., Tumor antigen presentation by murine epidermal cells. J Immunol. May 15, 1991;146(10):3656-61.
Graf, M. et al., Codon-optimized genes that enable increased heterologous expression in mammalian cells and elicit efficient immune responses in mice after vaccination of naked DNA. Methods Mol Med. 2004;94:197-210.
Graham, F.L., et al., A new technique for the assay of infectivity of human adenovirus 5 DNA. Virology. Apr. 1973;52(2):456-67.
Gram, G.J. et al., Immunological analysis of a Lactococcus lactis-based DNA vaccine expressing HIV gp120. Genet Vaccines Ther. Jan. 29, 2007;5:3.
Granstein, R.D. et al., Induction of anti-tumor immunity with epidermal cells pulsed with tumor-derived RNA or intradermal administration of RNA. J Invest Dermatol. Apr. 2000;114(4):632-6.
Greenblatt, M.S. et al., Mutations in the p53 tumor suppressor gene: clues to cancer etiology and molecular pathogenesis. Cancer Res. Sep. 15, 1994;54(18):4855-78.
Grentzmann, G. et al., A dual-luciferase reporter system for studying recoding signals. RNA. Apr. 1998;4(4):479-86.
Grosjean, H., Modification and editing of RNA: historical overview and important facts to remember. Fine-tuning of RNA functions by modification and editing. Topics Curr Gen. Jan. 2005; 12: 1-22.
Gross, G. et al., Heterologous expression as a tool for gene identification and analysis. J Biol Chem. Jul. 31, 1995;41(2):91-110.
Grudzien, E. et al., Novel cap analogs for in vitro synthesis of mRNAs with high translational efficiency. RNA. Sep. 2004;10(9):1479-87.
Grudzien-Nogalska, E. et al., Phosphorothioate cap analogs stabilize mRNA and increase translational efficiency in mammalian cells. RNA. Oct. 2007;13(10):1745-55. Epub Aug. 24, 2007.
Gryaznov, S.M., Oligonucleotide N3'→P5' phosphoramidates as potential therapeutic agents. Biochim Biophys Acta. Dec. 10, 1999;1489(1):131-40.
Guhaniyogi, J. et al., Regulation of mRNA stability in mammalian cells. Gene. Mar. 7, 2001;265(1-2):11-23.
Guo, L. et al., Structure and function of a cap-independent translation element that functions in either the 3' or the 5' untranslated region. RNA. Dec. 2000;6(12):1808-20.
Haas, J. et al., Codon usage limitation in the expression of HIV-1 envelope glycoprotein. Curr Biol. Mar. 1, 1996;6(3):315-24.
Hakelien, A.M., et al., Novel approaches to transdifferentiation. Cloning Stem Cells. 2002;4(4):379-87.
Hakelien, A.M., Reprogramming fibroblasts to express T-cell functions using cell extracts. Nat Biotechnol. May 2002;20(5):460-6.
Hambraeus, G. et al., A 5' stem-loop and ribosome binding but not translation are important for the stability of Bacillus subtilis aprE leader mRNA. Microbiology. Jun. 2002;148(Pt 6):1795-803.
Hancock, J.F., Reticulocyte lysate assay for in vitro translation and posttranslational modification of Ras proteins. Methods Enzymol. 1995;255:60-5.
Hannon, G.J. et al., Trans splicing of nematode pre-messenger RNA in vitro. Cell. Jun. 29, 1990;61(7):1247-55.
Harel, J ., Action of polyribonucleotides, extracted by the phenol method, on the growth of mouse tumor cells. C.R. Hebd Seances Acad. Sci., 1962, 254:4390-2.
Harris, J. et al., An improved RNA amplification procedure results in increased yield of autologous RNA transfected dendritic cell-based vaccine. Biochim Biophys Acta. Jun. 20, 2005;1724(1-2):127-36. Epub Apr. 7, 2005.
Hausmann, R., Bacteriophage T7 genetics. Curr Top Microbiol Immunol. 1976;75:77-110.
Hays, E.F. et al., Induction of mouse leukaemia with purified nucleic acid preparations. Nature. Dec. 21, 1957;180(4599):1419-20.
He, K. et al., Synthesis and Separation of Diastereomers of Ribonucleoside 5'-(alpha-P-Borano)triphosphates. J Org Chem. Aug. 21, 1998;63(17):5769-5773.
Hecker, J.G. et al., Non-Viral DNA and mRNA Gene Delivery to the CNS Pre-Operatively for Neuroprotection and Following Neurotrauma. Molecular Therapy. 2004; 9, S258-S258.
Hedman, M, et al., Safety and feasibility of catheter-based local intracoronary vascular endothelial growth factor gene transfer in the

(56) References Cited

OTHER PUBLICATIONS prevention of postangioplasty and in-stent restenosis and in the treatment of chronic myocardial ischemia: phase II results of the Kuopio Angiogenesis Trial (KAT). Circulation. Jun. 3, 2003; 107(21): 2677-83. Epub May 12, 2003.
Heidenreich, O. et al., Chemically modified RNA: approaches and applications. FASEB J. Jan. 1993;7(1):90-6.
Heidenreich, O. et al., High activity and stability of hammerhead ribozymes containing 2'-modified pyrimidine nucleosides and phosphorothioates. J Biol Chem. Jan. 21, 1994;269(3):2131-8.
Heil, F. et al., Species-specific recognition of single-stranded RNA via toll-like receptor 7 and 8. Science. Mar. 5, 2004;303(5663):1526-9. Epub Feb. 19, 2004.
Heilman, K.L. et al., Internal 6-methyladenine residues increase the in vitro translation efficiency of dihydrofolate reductase messenger RNA. Int J Biochem Cell Biol. Jul. 1996; 28(7): 823-829.
Heiser, A. et al., Autologous dendritic cells transfected with prostate-specific antigen RNA stimulate CTL responses against metastatic prostate tumors. J Clin Invest. Feb. 2002;109(3):409-17.
Heiser, A. et al., Human dendritic cells transfected with renal tumor RNA stimulate polyclonal T-cell responses against antigens expressed by primary and metastatic tumors. Cancer Res. Apr. 15, 2001;61(8):3388-93.
Heiser, A. et al., Human dendritic cells transfected with RNA encoding prostate-specific antigen stimulate prostate-specific CTL responses in vitro. J Immunol. May 15, 2000;164(10):5508-14.
Heiser, A. et al., Induction of polyclonal prostate cancer-specific CTL using dendritic cells transfected with amplified tumor RNA. J Immunol. Mar. 1, 2001;166(5):2953-60.
Helbock, H.J. et al. N2-methyl-8-oxoguanine: a tRNA urinary metabolite—role of xanthine oxidase. Free Radic Biol Med. 1996;20(3):475-81.
Hemmi, H. et al, A Toll-like receptor recognizes bacterial DNA. Nature. Dec. 7, 2000;408(6813):740-5.
Herweijer, H. et al., Gene therapy progress and prospects: hydrodynamic gene delivery. Gene Ther. Jan. 2007;14 (2):99-107. Epub Nov. 30, 2006.
Hess, M. et al., The effects of nucleic acids on pituitary ACTH content. Endocrinology. Mar. 1961;68:548-52.
Higman, M.A. et al., The mRNA (guanine-7-)methyltransferase domain of the vaccinia virus mRNA capping enzyme. Expression in *Escherichia coli* and structural and kinetic comparison to the intact capping enzyme. J Biol Chem. May 27, 1994;269(21):14974-81.
Higman, M.A. et al., The vaccinia virus mRNA (guanine-N7-)-methyltransferase requires both subunits of the mRNA capping enzyme for activity. J Biol Chem. Aug. 15, 1992;267(23):16430-7.
Hilleren, P. et al., Mechanisms of mRNA surveillance in eukaryotes. Annu Rev Genet. 1999;33:229-60.
Hillman, N.W. et al., Chick Cephalogenesis, I. The Effect of RNA on Early Cephalic Development. PNAS, 1963, 50:486-93.
Ho, CS., et al., Electrospray ionisation mass spectrometry: Principles and clinical applications. Clin Biochem Rev. Feb. 2003; 24: 3-12.
Hoath, S.B. et al., The organization of human epidermis: functional epidermal units and phi proportionality. J Invest Dermatol. Dec. 2003;121(6):1440-6.
Warren, L. et al. Highly efficient reprogramming to pluripotency and directed differentiation of human cells with synthetic modified mRNA. Cell Stem Cell. Nov. 5, 2010;7(5):618-30.
Kormann, M. et al. Expression of therapeutic proteins after delivery of chemically modified mRNA in mice. Nat Biotechnol. Feb. 2011;29(2):154-7.
Hoerr, I. et al., In vivo application of RNA leads to induction of specific cytotoxic T lymphocytes and antibodies. Eur J Immunol. Jan. 2000;30(1):1-7.
Hoerr, I. et al., Stabilized Messenger RNA (RNActive™) as a Tool for Innovative Gene Delivery. Tissue Engineering. Apr. 2007; 13(4): 865-925.

Holcik, M. et al., Four highly stable eukaryotic mRNAs assemble 3' untranslated region RNA-protein complexes sharing cis and trans components. oc Natl Acad Sci U S A. Mar. 18, 1997;94(6):2410-4.
Holmes, D. et al., Cell positioning and sorting using dielectrophoresis. Eur Cell Mater. 2002; 4(2):120-2.
Holtkamp, S. et al., Modification of antigen-encoding RNA increases stability, translational efficacy, and T-cell stimulatory capacity of dendritic cells. Blood. Dec. 15, 2006;108(13):4009-17.
Houghton, A.N. et al., Cancer antigens: immune recognition of self and altered self. J Exp Med. Jul. 1, 1994;180(1):1-4.
Hsu, F.J. et al., Vaccination of patients with B-cell lymphoma using autologous antigen-pulsed dendritic cells. Nat Med. Jan. 1996;2(1):52-8.
Hu, B., et al., Neural differentiation of human induced pluripotent stem cells follows developmental principles but with variable potency. Natl Acad Sci. Mar. 2010; 107(9): 4335-4340.
Hu, S. et al., Codon optimization, expression, and characterization of an internalizing anti-ErbB2 single-chain antibody in Pichia pastoris. Protein Expr Purif. May 2006;47(1):249-57. Epub Dec. 13, 2005.
Huangfu, D., et al., Induction of pluripotent stem cells by defined factors is greatly improved by small-molecule compounds. Nat Biotech. Jul. 2008; 26(7) 795-797.
Huddleston, J.A. et al., The sequence of the nucleoprotein gene of human influenza A virus, strain A/NT/60/68. Nucleic Acids Res. Feb. 11, 1982;10(3):1029-38.
Hue, K.K. et al., A polypurine sequence that acts as a 5' mRNA stabilizer in Bacillus subtilis. J Bacteriol. Jun. 1995;177(12):3465-71.
Hung, C.F. et al., Ovarian cancer gene therapy using HPV-16 pseudovirion carrying the HSV-tk gene. PLoS ONE. Jul. 2012; 7(7): e40983.
Inaba, K. et al., Dendritic cells pulsed with protein antigens in vitro can prime antigen-specific, MHC-restricted T cells in situ. J Exp Med. Aug. 1, 1990;172(2):631-40.
Inaba, K. et al., Direct activation of CD8+ cytotoxic T lymphocytes by dendritic cells. J Exp Med. Jul. 1, 1987;166(1):182-94.
Inaba, K. et al., Generation of large numbers of dendritic cells from mouse bone marrow cultures supplemented with granulocyte/macrophage colony-stimulating factor. J Exp Med. Dec. 1, 1992;176(6):1693-702.
International Search Report from International Application No. PCT/US11/54617 dated Oct. 3, 2011.
International Search Report from International Application No. PCT/US11/54617 dated Feb. 1, 2012.
International Search Report from International Application No. PCT/US2012/031781 dated Jan. 11, 2013.
International Search Report from International Application No. PCT/US12/54561 dated Feb. 26, 2013.
International Search Report from International Application No. PCT/US12/58519 dated Feb. 28, 2013.
International Search Report from International Application No. PCT/US12/68732 dated Feb. 22, 2013.
International Search Report from International Application No. PCT/US12/69610 dated Feb. 27, 2013.
International Search Report from International Application No. PCT/US12/71105 dated Mar. 5, 2013.
International Search Report from International Application No. PCT/US13/20921 dated Mar. 26, 2013.
International Search Report from International Application No. PCT/US12/71118 dated Apr. 5, 2013.
Ito, M.K., ISIS 301012 gene therapy for hypercholesterolemia: sense, antisense, or nonsense? Ann Pharmacother. Oct. 2007; 41(10): 1669-78.
Ivanovska, N. et al., Immunization with a DNA chimeric molecule encoding a hemagglutinin peptide and a scFv CD21-specific antibody fragment induces long-lasting IgM and CTL responses to influenza virus. Vaccine. Mar. 10, 2006;24(11):1830-7. Epub Nov. 2, 2005.
Iwasaki, A. et al., Enhanced CTL responses mediated by plasmid DNA immunogens encoding costimulatory molecules and cytokines. J Immunol. May 15, 1997;158(10):4591-601.

(56) References Cited

OTHER PUBLICATIONS

Jady, B.E. et al., A small nucleolar guide RNA functions both in 2'-O-ribose methylation and pseudouridylation of the U5 spliceosomal RNA. EMBO J. Feb. 1, 2001;20(3):541-51.
Janeway, C. et al., Immunobiology: the immune system in health and disease. Garland Publishing, Inc, London. 1997; 13:12-13:21.
Jansen, P.L.M., Diagnosis and management of Crigler-Najjar syndrome. Eur J Pediatr. Dec. 1999;158 [Suppl 2]:S89-S94.
Janssens, S. et al., Role of Toll-like receptors in pathogen recognition. Clin Microbiol Rev. Oct. 2003;16(4):637-46.
Jemielity, J. et al., Novel "anti-reverse" cap analogs with superior translational properties. RNA. Sep. 2003;9(9):1108-22.
Jia, F., et al., A nonviral minicircle vector for deriving human iPS Cells. Nat Methods. Mar. 2010; 7(3): 197-199.
Jia, Z., et al., Long-term correction of hyperbilirubinemia in the Gunn Rat by repeated intravenous delivery of naked plasmid DNA into muscle. Mol Ther. Nov. 2005; 12(5): 860-866.
Jiang, J. et al., Topical application of ketoconazole stimulates hair growth in C3H/HeN mice. J Dermatol. Apr. 2005;32(4):243-7.
Jirikowski, G.F., et al., Reversal of diabetes insipidus in Brattleboro Rats: Intrahypothalamic injection of vasopressin mRNA. Science. Feb. 1992; 255(5047): 996-998.
Johnson, K.M. et al., Role of heparan sulfate in attachment to and infection of the murine female genital tract by human papillomavirus. J Virol. Mar. 2009; 83(5): 2067-2074.
Jones, P.C.T., An Alteration in Cell Morphology under the Influence of a Tumor RNA. Nature, 1964,202:1226-7.
Juliano, R.L., et al., Cell-targeting and cell-penetrating peptides for delivery of therapeutic and imaging agents. Wiley Interdisciplinary Reviews: Nanomedicine and Nanobiotechnology. May/Jun. 2009; 1(3): 324-335.
Kabanov, A.V. et al., A new class of antivirals: antisense oligonucleotides combined with a hydrophobic substituent effectively inhibit influenza virus reproduction and synthesis of virus-specific proteins in MDCK cells. FEBS Lett. Jan. 1, 1990;259(2):327-30.
Kahan, F.M. et al., The role of deoxyribonucleic acid in ribonucleic acid synthesis. J Biological Chem. Dec. 1962; 287(12): 3778-3785.
Kaji, K., et al., Virus free induction of pluripotency and subsequent excision of reprogramming factors. Nature. Apr. 2009; 458(7239): 771-775.
Kalnins, A. et al., Sequence of the lacZ gene of *Escherichia coli*. EMBO J. 1983;2(4):593-7.
Kanaya, S. et al., Codon usage and tRNA genes in eukaryotes: correlation of codon usage diversity with translation efficiency and with CG-dinucleotide usage as assessed by multivariate analysis. J Mol Evol. Oct.-Nov. 2001;53(4-5):290-8.
Kandimalla, E.R. et al., Divergent synthetic nucleotide motif recognition pattern: design and development of potent immunomodulatory oligodeoxyribonucleotide agents with distinct cytokine induction profiles. Nucleic Acids Res. May 1, 2003;31(9):2393-400.
Kandimalla, E.R. et al., Immunomodulatory oligonucleotides containing a cytosine-phosphate-2'-deoxy-7-deazaguanosine motif as potent toll-like receptor 9 agonists. Proc Nati Acad Sci U S A. May 10, 2005;102(19):6925-30. Epub Apr. 28, 2005.
Karande, A.A.,et al., In vitro induction of chronic myeloid leukemia associated immune reactivity in normal human lymphocytes by xenogeneic immune RNA Neoplasma, 1983, 30(4):403-9.
Kariko, K. et al., Incorporation of pseudouridine into mRNA yields superior nonimmunogenic vector with increased translational capacity and biological stability. Mol Ther. Nov. 2008;16(11):1833-40. Epub Sep. 16, 2008.
Kariko, K. et al., Phosphate-enhanced transfection of cationic lipid-complexed mRNA and plasmid DNA. Biochim Biophys Acta. Mar. 2, 1998;1369(2):320-34.
Kariko, K., et al., In vivo protein expression from mRNA delivered into adult rat brain. J. of Neuroscience Methods. Jan. 2001; 105(1): 77-86.
Kariko, K. et al., mRNA is an endogenous ligand for Toll-like receptor 3. J Biol Chem. Mar. 26, 2004;279(13):12542-50. Epub Jan. 16, 2004.
Kariko, K. et al., Suppression of RNA recognition by Toll-like receptors: the impact of nucleoside modification and the evolutionary origin of RNA. Immunity. Aug. 2005;23(2):165-75.
Kariko, K., et al., Increased erythropoiesis in mice injected with submicrogram quantities of pseudouridine-containing mRNA encoding erythropoietin. Mol Ther. May 2012; 20(5): 948-953.
Karlin, S. et al., Applications and statistics for multiple high-scoring segments in molecular sequences. Proc Natl Acad Sci U S A. Jun. 15, 1993;90(12):5873-7.
Katre, N.V. et al., Chemical modification of recombinant interleukin 2 by polyethylene glycol increases its potency in the murine Meth A sarcoma model. Proc Natl Acad Sci U S A. Mar. 1987;84(6):1487-91.
Katz, N., et al., Rapid onset of cutaneous anesthesia with EMLA cream after pretreatment with a new ultrasound-emitting device. Anesth Analg. 2004; 98: 371-376.
Kawai, T., et al., Antiviral signaling through pattern recognition receptors. J. Biochem. 2007; 141(2): 137-145.
Kawamura, T., et al., Linking the p53 tumor suppressor pathway to somatic cell reprogramming. Nature. Aug. 2009; 460(7259): 1140-1144.
Kazmierczak, K.M. et al., The phage N4 virion RNA polymerase catalytic domain is related to single-subunit RNA polymerases. EMBO J. Nov. 1, 2002;21(21):5815-23.
Keith, B., et al., HIF1a and HIF1a: sibling rivalry in hypoxic tumor growth and progression. Nat Rev Cancer. Jul. 2012; 12(1): 9-22.
Keller, E.B. et al., Intron splicing: a conserved internal signal in introns of animal pre-mRNAs. Proc Natl Acad Sci U S A. Dec. 1984;81(23):7417-20.
Keown, W.A., et al., [41] Methods for Introducing DNA into Mammalian Cells. Methods in Enzymology, 1990, 185:527-37.
Keshishian, H., et al., Quantification of cardiovascular biomarkers in patient plasma by targeted mass spectrometry and stable isotope dilution. Mol Cell Proteomics. Oct. 2009; 8(10): 2339-2349.
Kesselheim, A.S., An empirical review of major legislation affecting drug development: Past experiences, effects, and unintended consequences. The Milbank Quarterly. 2011; 89(3): 450-502.
Khare, P.D. et al., Tumor growth suppression by a retroviral vector displaying scFv antibody to CEA and carrying the iNOS gene. Anticancer Res. Jul.-Aug. 2002;22(4):2443-6.
Khullar, N. et al., Comparative evaluation of the protective effect of immune spleen cells and immune RNA against Plasmodium berghei. Ann. Trop. Med. Parasitol., 1988, 82(6):519-26.
Kim, C.H. et al., Codon optimization for high-level expression of human erythropoietin (EPO) in mammalian cells. Gene. Oct. 15, 1997;199(1-2):293-301.
Kim, D., et al., Generation of human induced pluripotent stem cells by direct delivery of reprogramming proteins. Cell Stem Cell. Jun. 2009; 4(6): 472-476.
Kim, S.H., et al., Opsonized erythrocyte ghosts for liver-targeted delivery of antisense oligodeoxynucleotides. Biomaterials. Feb. 2009; 30(5): 959-967. Epub Nov. 22, 2008.
Kines, R.C. et al., The initial steps leading to papillomavirus infection occur on the basement membrane prior to cell surface binding. PNAS. Dec. 1, 2009; 106(48): 20458-20463.
Kinosita, K. Jr. et al., Formation and resealing of pores of controlled sizes in human erythrocyte membrane. Nature. Aug. 4, 1977;268(5619):438-41.
Kirby, K.S., A New Method for the Isolation of Ribonucleic Acids from Mammalian Tissues. J. Biochem., 1956, 64:405.
Kirshenbaum, et al., Designing polymers that mimic biomolecules. Curr Opin Struct Biol, 1999, 9:530-5.
Kirpotin, D.B., et al., Antibody targeting of long-circulating lipidic nanoparticles does not increase tumor localization but does increase internalization in animal models. Cancer Res. 2006; 66: 6732-6740.
Kiss, T., Small nucleolar RNA-guided post-transcriptional modification of cellular RNAs. EMBO J. Jul. 16, 2001;20 (14):3617-22.
Kiss, T., Small nucleolar RNAs: an abundant group of noncoding RNAs with diverse cellular functions. Cell. Apr. 19, 2002;109(2):145-8.

(56) References Cited

OTHER PUBLICATIONS

Kitaguchi, K. et al., Immune deficiency enhances expression of recombinant human antibody in mice after nonviral in vivo gene transfer. Int J Mol Med. Oct. 2005;16(4):683-8.
Klinman, D.M. et al., DNA vaccines: safety and efficacy issues. Springer Semin Immunopathol. 1997;19(2):245-56.
Koch, G. and Bishop, J.M. The effect of polycations on the interaction of viral RNA with mammalian cells: Studies on the infectivity of single- and double-stranded poliovirus RNA. Virology. May 1968; 35(1): 9-17.
Koch, G., et al., Quantitative Studies on the Infectivity of ribonucleic acid from partially purified and highly purified poliovirus preparations. Virology. Mar. 1960; 10(3): 329-343.
Koch, G., et al., An agar cell-suspension plaque assay for isolated viral RNA. Biochem and Biophys Res Comm. 1966; 24(3): 304-309.
Kohler, G. et al., Continuous cultures of fused cells secreting antibody of predefined specificity. Nature. Aug. 7, 1975;256(5517):495-7.
Koide, Y. et al., DNA vaccines. Jpn J Pharmacol. Jul. 2000;83(3):167-74.
Koido, S. et al., Induction of antitumor immunity by vaccination of dendritic cells transfected with MUC1 RNA. J Immunol. Nov. 15, 2000;165(10):5713-9.
Kolb, A.F. et al., A virus-neutralising antibody is not cytotoxic in vitro. Mol Immunol. Feb. 2006;43(6):677-89.
Komar, A.A. et al., Synonymous codon substitutions affect ribosome traffic and protein folding during in vitro translation. FEBS Lett. Dec. 3, 1999;462(3):387-91.
Kontermann, R.E. et al., Recombinant bispecific antibodies for cancer therapy. Acta Pharmacol Sin. Jan. 2005;26(1):1-9.
Korsten, K.H. et al., The strategy of infection as a criterion for phylogenetic relationships of non-coli phages morphologically similar to phage T7. J Gen Virol. Apr. 1979;43(1):57-73.
Koski, G.K. et al., Cutting edge: innate immune system discriminates between RNA containing bacterial versus eukaryotic structural features that prime for high-level IL-12 secretion by dendritic cells. J Immunol. Apr. 1, 2004;172(7):3989-93.
Krieg, P.A. et al., Functional messenger RNAs are produced by SP6 in vitro transcription of cloned cDNAs. Nucleic Acids Res. Sep. 25, 1984;12(18):7057-70.
Krieg, P.A. et al., In vitro RNA synthesis with SP6 RNA polymerase. Methods Enzymol. 1987;155:397-415.
Kreiter, S., et al., Intranodal vaccination with naked antigen-encoding RNA elicits potent prophylactic and therapeutic antitumoral immunity. Cancer Res. 2010; 70: 9031-9040.
Kreiter, S., et al., Tumor vaccination using messenger RNA: prospects of a future therapy. Curr Opinion in Immun. Jun. 2011; 23(3): 399-406.
Kudla, G. et al., High guanine and cytosine content increases mRNA levels in mammalian cells. PLoS Biol. Jun. 2006;4(6):e180. Epub May 23, 2006.
Kufe, D.W. et al., Holland-Frei cancer medicine, 6th edition. Hamilton (ON): BC Decker; 2003; Table 12-1.
Kugler, A. et al., Regression of human metastatic renal cell carcinoma after vaccination with tumor cell-dendritic cell hybrids. Nat Med. Mar. 2000;6(3):332-6.
Kuhn, A.N., et al., mRNA as a versatile tool for exogenous protein expression. Current Gene Therapy. Oct. 2012; 12(5): 347-361.
Meijer, H.A., et al. Translational Repression and eIF4A2 Activity are Critical for MicroRNA-Mediated Gene Regulation. Science 340, 82-85, Apr. 5, 2013.
Wilusz, Jeremy E., et al. 3' end processing of a long nuclear-retained non-coding RNA yields a tRNAlike cytoplasmic RNA, Cell, Nov. 28, 2008, 135(5) pp. 919-932.
Peart, Natoya, et al., Non-mRNA 3' end formation: how the other half lives, WIREs RNA 2013, doi: 10.1002/wrna.1174, pp. 1-16.

Kore, Anilkumar R., et al. Synthesis and biological validation of N7-(4-chlorophenoxyethyl) substituted dinucleotide cap analogs for mRNA translation. Bioorganic & Medicinal Chemistry 21 (2013), pp. 4570-4574.
Bolukbasi, Mehmet Fatih, et al. miR-1289 and "Zipcode"-like Sequence Enrich mRNAs in MIcrovesicles. Molecular Therapy—Nucleic Acids (2012) 1, e10: doi:10.1038/mtna.2011.2, pp. 1-10.
Conry, R.M. et al., Characterization of a messenger RNA polynucleotide vaccine vector. Cancer Res. Apr. 1, 1995;55(7):1397-1400.
Conry, R.M. et al., Immune response to a carcinoembryonic antigen polynucleotide vaccine. Cancer Res. Mar. 1, 1994;54(5):1164-8.
Conry, R.M. et al., A carcinoembryonic antigen polynucleotide vaccine has in vivo antitumor activity. Gene Ther. Jan. 1995;2(1):59-65.
Copreni, E. et al., Lentivirus-mediated gene transfer to the respiratory epithelium: a promising approach to gene therapy of cystic fibrosis. Gene Ther. Oct. 2004;11 Suppl 1:S67-75.
Cortes, J.J. et al. Mutations in the conserved loop of human U5 snRNA generate use of novel cryptic 5' splice sites in vivo. EMBO J. Dec. 15, 1993;12(13):5181-9.
Coughlin, C.M. et al., Targeting adult and pediatric cancers via cell-based vaccines and the prospect of activated B lymphocytes as a novel modality. Cancer Biol Ther. Sep.-Oct. 2003;2(5):466-70.
Cox, G.J. et al., Bovine herpesvirus 1: immune responses in mice and cattle injected with plasmid DNA. J Virol. Sep. 1993;67(9):5664-7.
Craig, J.M. et al., The distribution of CpG islands in mammalian chromosomes. Nat Genet. Jul. 1994;7(3):376-82.
Cramer, P. et al., Functional association between promoter structure and transcript alternative splicing. Proc Natl Acad Sci U S A. Oct. 14, 1997;94(21)11456-60.
Cree, B. et al., Tolerability and effects of rituxamab (anti CD20 antibody) in neuromyelitis optica (NMO) and rapidly worsening multiple sclerosis (MS). Neurology. 2004; 62(S5):A492.
Cuburu, N. et al., Intravaginal immunization with HPV vectors induces tissue-resident CD8+ T cell responses. J Clin Invest. Dec. 3, 2012; 122(12): 4606-4620.
Culver, K.W. et al., Gene Therapy, A Handbook for Physicians. Mary Ann Lieber, Inc, New York. 1994; 63-77.
Cunningham, S., et al., AAV2/8-mediated correction of OTC deficiency is robust in adult but not neonatal Spf$^\wedge$ash Mice. Mol Ther. Aug. 2009; 17(8): 1340-1346.
Daguer, J.P. et al., Increasing the stability of sacB transcript improves levansucrase production in Bacillus subtilis. Lett Appl Microbiol. 2005;41(2):221-6.
Dai, M.S. et at., Introduction of human erythropoietin receptor complementary DNA by retrovirus-mediated gene transfer into murine embryonic stem cells enhances erythropoiesis in developing embryoid bodies. Biol Blood Marrow Transplant. 2000;6(4):395-407.
Davidson, E.H., An Analysis of Niu Menchang's Research on Transformation by RNA. Biotechnology in China, 1989, 92-102.
Davis, H.L. et al., DNA-based immunization induces continuous secretion of hepatitis B surface antigen and high levels of circulating antibody. Hum Mol Genet. Nov. 1993;2(11):1847-51.
De Carvalho, S. et al., Biologic properties of human leukemic and tumoral RNA. IV. Leukemia and neoplasms induced in mice with human leukemic RNA carried in tissue culture. J Lab Clin Med. May 1960;55:706-14.
De Carvalho, S. et al., Comparative effects of liver and tumour ribonucleic acids on the normal liver and the Novikoff hepatoma cells of the rat. Nature. Mar. 11, 1961;189:815-7.
De Carvalho, S. et al., Differences in information content of ribonucleic acids from malignant tissues and homologous organs as expressed by their biological activities. Exp Mol Pathol. Apr. 1962;1:96-103.
De Carvalho, S., Angiokines, angiogenesis and angiolymphoproliferative syndromes (ALPS). Angiology. Apr. 1983;34(4):231-43.

(56) References Cited

OTHER PUBLICATIONS

De Carvalho, S., Biologic properties of human leukemic and tumoral RNA. III. The effect of different media on the cytopathogenicitv in tissue culture. J Lab Clin Med. May 1960;55:694-705.
De Carvalho, S., Cancer 1974: an analytical vademecum of oncologic relevance. Oncology. 1973;28(4):289-98.
De Carvalho, S., Effect of RNA from normal human bone marrow on leukaemic marrow in vivo. Nature. Mar. 16, 1963;197:1077-80.
De Carvalho, S., Epigenetic transformation by RNA from human neoplastic cells. Oncology. 1973;27(1):3-29.
De Carvalho, S., In vitro angiogenic activity of RNA from leukemic lymphocytes. Angiology. Jul. 1978;29(7):497-505.
De Carvalho, S., Natural history of congenital leukemia. An experiment of nature revealing unexplored features of fetal-maternal isoimmunity, longest recorded survival following use of leukemostatic maternal isoantibody. Oncology. 1973;27(1):52-63.
De Lucca, F.L. et al., Effect of the calcium phosphate-mediated RNA uptake on the transfer of cellular immunity of a synthetic peptide of HIV-1 to human lymphocytes by exogenous RNA. Mol Cell Biochem. Dec. 2001;228(1-2):9-14.
Delafontaine, P. et al., Regulation of vascular smooth muscle cell insulin-like growth factor I receptors by phosphorothioate oligonucleotides. Effects on cell growth and evidence that sense targeting at the ATG site increases receptor expression. J Biol Chem. Jun. 16, 1995;270(24):14383-8.
Deres, K. et al., In vivo priming of virus-specific cytotoxic T lymphocytes with synthetic lipopeptide vaccine. Nature. Nov. 30, 1989;342(6249):561-4.
Deshayes, S. et al., Cell-penetrating peptides: tools for intracellular delivery of therapeutics. Cell Mol Life Sci. Aug. 2005;62(16):1839-49.
Desrosiers, R. et al., Identification of methylated nucleosides in messenger RNA from Novikoff hepatoma cells. Proc Natl Acad Sci U S A. Oct. 1974;71(10):3971-5.
Diebold, S.S. et al., Innate antiviral responses by means of TLR7-mediated recognition of single-stranded RNA. Science. Mar. 5, 2004;303(5663)1529-31. Epub Feb. 19, 2004.
Dimari, J.F. et al., Initiation of mRNA decay in Bacillus subtilis. Mol Microbiol. Mar. 1993;7(5):705-17.
Ding, Z., et al., State-of-the-art 2003 on PKU gene therapy. Mol Genet Metab. Jan. 2004; 81(1): 3-8.
Dingman, W. et al., Molecular theories of memory. Science. Apr. 3, 1964;144(3614):26-9.
Disbrow, G.L. et al., Codon optimization of the HPV-16 E5 gene enhances protein expression. Virology. Jun. 20, 2003;311(1)105-14.
Dong, Y. et al., Poly(d,l-lactide-co-glycolide)/montmorillonite nanoparticles for oral delivery of anticancer drugs. Biomaterials. Oct. 2005;26(30):6068-76.
Donnelly, J. et al., Technical and regulatory hurdles for DNA vaccines. Int J Parasitol. May 2003;33(5-6):457-67.
Dubes, G.R. and Klingler, E.A. Jr. Facilitation of infection of monkey cells with poliovirus "ribonucleic acid." Science. Jan. 1961; 133(3446): 99-100.
Dunham, S.P. et al., The application of nucleic acid vaccines in veterinary medicine. Res Vet Sci. Aug. 2002;73(1):9-16.
Dunn, J.J. et al., Different template specificities of phage T3 and T7 RNA polymerases. Nat New Biol. Mar. 17, 1971;230(11):94-6.
Duret, L. et al., Expression pattern and, surprisingly, gene length shape codon usage in Caenorhabditis, Drosophila, and Arabidopsis. Proc Natl Acad Sci U S A. Apr. 13, 1999;96(8):4482-7.
Duret, L., Evolution of synonymous codon usage in metazoans. Curr Opin Genet Dev. Dec. 2002;12(6):640-9.
Earl, R.A., et al., A chemical synthesis of the nucleoside 1-Methylpseudouridine. A facile chemical synthesis of 1-methylpseudouridine has been accomplished by direct methylation of pseudouridine. J Heterocyclic Chem. Jun. 1977; 14:699-700.

Easton, L.E. et al., Rapid, nondenaturing RNA purification using weak anion-exchange fast performance liquid chromatography. RNA. Mar. 2010;16(3):647-53. Epub Jan. 25, 2010.
Eberwine, J. et al., Analysis of gene expression in single live neurons. Proc Natl Acad Sci U S A. Apr. 1, 1992;89(7):3010-4.
Edelstein, M. L. et al., Gene therapy clinical trials worldwide 1989-2004—an overview. J Gene Med. Jun. 2004;6(6):597-602.
Edery, I. et al., An efficient strategy to isolate full-length cDNAs based on an mRNA cap retention procedure (CAPture). Mol Cell Biol. 1995; 15(6): 3363-3371.
Edmonds, M., Polyadenylate polymerases. Methods Enzymol. 1990;181:161-70.
Samarsky, D.A. et al., The snoRNA box C/D motif directs nucleolar targeting and also couples snoRNA synthesis and localization. EMBO J. Jul. 1, 1998;17(13):3747-57.
Santini, S.M. et al., Type I interferon as a powerful adjuvant for monocyte-derived dendritic cell development and activity in vitro and in Hu-PBL-SCID mice. J Exp Med. May 15, 2000;191(10):1777-88.
Sanyal, S. et al., Effects of RNA on the developmental potentiality of the posterior primitive streak of the chick blastoderm. Proc Natl Acad Sci U S A. Apr. 1966;55(4):743-50.
Saponara, A.G. et al., The isolation from ribonucleic acid of substituted uridines containing alpha-aminobutyrate moieties derived from methionine. Biochim Biophys Acta. Apr. 27, 1974;349(1):61-77.
Satoh, M. et al., X-linked immunodeficient mice spontaneously produce lupus-related anti-RNA helicase A autoantibodies, but are resistant to pristane-induced lupus. Int Immunol. Sep. 2003;15(9):1117-24.
Satthaporn, S. et al., Dendritic cells (II): Role and therapeutic implications in cancer. J R Coll Surg Edinb. Jun. 2001;46(3):159-67.
Satz, M.L. et al., Mechanism of immune transfer by RNA extracts. Immune RNA induces the synthesis of idiotype-bearing antigen receptors in noncommitted cells. Mol Cell Biochem. Dec. 16, 1980;33(3):105-13.
Scheel, B. et al., Immunostimulating capacities of stabilized RNA molecules. Eur J Immunol. Feb. 2004;34(2):537-47.
Schirrmacher, V. et al., Intra-pinna anti-tumor vaccination with self-replicating infectious RNA or with DNA encoding a model tumor antigen and a cytokine. Gene Ther. Jul. 2000;7(13):1137-47.
Schmidt, W.M. et al., CapSelect: a highly sensitive method for 5' CAP-dependent enrichment of full-length cDNA in PCR-mediated analysis of mRNAs. Nucleic Acids Res. Nov. 1, 1999;27(21):e31.
Schmitt, W.E. et al., In vitro induction of a bladder cancer-specific T-cell response by mRNA-transfected dendritic cells. J Cancer Res Clin Oncol. 2001;127(3):203-6.
Scholte, B.J. et al., Animal models of cystic fibrosis. J Cyst Fibros. Aug. 2004;3 Suppl 2:183-90.
Schott, J.W., et al., Viral and non-viral approaches for transient delivery of mRNA and proteins. Current Gene Ther. 2011; 11(5): 382-398.
Schuler, G. et al., Murine epidermal Langerhans cells mature into potent immunostimulatory dendritic cells in vitro. J Exp Med. Mar. 1, 1985;161(3):526-46.
Schuler-Thurner, B. et al., Mage-3 and influenza-matrix peptide-specific cytotoxic T cells are inducible in terminal stage HLA-A2.1+ melanoma patients by mature monocyte-derived dendritic cells. J Immunol. Sep. 15, 2000;165(6):3492-6.
Segura, J., et al., Monitoring gene therapy by external imaging of mRNA: Pilot study on murine erythropoietin. Ther Drug Monit. Oct. 2007; 29(5): 612-8.
Semple, S.C., et al., Efficient encapsulation of antisense oligonucleotides in lipid vesicles using ionizable aminolipids: formation of novel small multilamellar vesicle structures. Biochim Biophys Acta. Feb. 9, 2001; 1510(1-2): 152-166.
Semple, S.C., et al., Rational design of cationic lipids for siRNA delivery. Nat Biotechnol. Feb. 2010; 28(2): 172-176.
Serrate, S. et al., Transfer of cellular immunity in vivo with immune RNA in an allogeneic murine model. Clin Immunol Immunopathol. Jan. 1982;22(1):75-82.

(56) References Cited

OTHER PUBLICATIONS

Sharp, J.S. et al., Effect of translational signals on mRNA decay in Bacillus subtilis. J Bacteriol. Sep. 2003;185(18):5372-9.
Sharp, P.M. et al., DNA sequence evolution: the sounds of silence. Philos Trans R Soc Lond B Biol Sci. Sep. 29, 1995;349(1329):241-7.
Shea, R.G. et al., Synthesis, hybridization properties and antiviral activity of lipid-oligodeoxynucleotide conjugates. Nucleic Acids Res. Jul. 11, 1990;18(13):3777-83.
Shi, Y., et al., A combined chemical and genetic approach for the generation of induced pluripotent stem cells. Cell Stem Cell. Jun. 2008; 2: 525-528.
Shingo, T. et al., Erythropoietin regulates the in vitro and in vivo production of neuronal progenitors by mammalian forebrain neural stem cells. J Neurosci. Dec. 15, 2001;21(24):9733-43.
Shuman, S. et al., Purification and characterization of a GTP-pyrophosphate exchange activity from vaccinia virions. Association of the GTP-pyrophosphate exchange activity with vaccinia mRNA guanylyltransferase . RNA (guanine-7-)methyltransferase complex (capping enzyme). J Biol Chem. Dec. 10, 1980;255(23):11588-98.
Shuman, S., Capping enzyme in eukaryotic mRNA synthesis. Prog Nucleic Acid Res Mol Biol. 1995;50:101-29.
Shuman, S., Structure, mechanism, and evolution of the mRNA capping apparatus. Prog Nucleic Acid Res Mol Biol. 2001;66:1-40.
Siena, S. et al., Expansion of Immunostimulatory Dendritic Cells from Peripheral Blood of Patients with Cancer. Oncologist. 1997;2(1):65-69.
Simonaro, C.M. et al., Joint and bone disease in mucopolysaccharidoses VI and VII: identification of new therapeutic targets and biomarkers using animal models. Pediatr Res. May 2005;57(5 Pt 1):701-7. Epub Mar. 3, 2005.
Slapikoff, S. et al., Mechanism of ribonucleic acid polymerase action. Effect of nearest neighbors on competition between uridine triphosphate and uridine triphosphate analogs for incorporation into ribonucleic acid. Biochemistry. Dec. 1967; 6(12): 3654-3658.
Sleeman, J. et al., Dynamic interactions between splicing snRNPs, coiled bodies and nucleoli revealed using snRNP protein fusions to the green fluorescent protein. Exp Cell Res. Sep. 15, 1998;243(2):290-304.
Smith, C.M. et al., Sno storm in the nucleolus: new roles for myriad small RNPs. Cell. May 30, 1997;89(5):669-72.
Smith, J.P., et al., Drug retention and distribution after intratumoral chemotherapy with fluorouracil/epinephrine injectable in gel in human pancreatic cancer xenografts. Cancer Chemother Pharmacol. 1999; 44: 267-274.
Smith, K.P. et al., Interactions of U2 gene loci and their nuclear transcripts with Cajal (coiled) bodies: evidence for PreU2 within Cajal bodies. Mol Biol Cell. Sep. 2000;11(9):2987-98.
Smith, W.S. et al., RNA modified uridines: VI: Conformations of 3-[3-(S)-Amino-3-Carboxypropyl]Uridine (acp3U) from tRNA and 1-Methyl-3-[3-(S)-Amino-3-Carboxypropyl]Pseudouridine (m1acp3?) from rRNA. Nucleosides and Nucleotides. 1992; 11(10):1683-94.
Smits, E., et al., RNA-based gene transfer for adult stem cells and T cells. Leukemia. 2004; 18: 1898-1902.
Smull, C.E., and Ludwig, E.H. Enhancement of the plaque-forming capacity of poliovirus ribonucleic acid with basic proteins. Journal of Bacteriology. 1962; 84(5): 1035-1040.
Sohn, R.L., et al., In-vivo particle mediated delivery of mRNA to mammalian tissues: ballistic and biological effects. Wound Rep and Regen. Jul.-Aug. 2001; 287-296.
Soll, D. Enzymatic modification of transfer RNA. Science. Jul. 23, 1971; 173(3994): 293-299.
Sontheimer, E.J. et al., The U5 and U6 small nuclear RNAs as active site components of the spliceosome. Science. Dec. 24, 1993;262(5142):1989-96.
Sousa, R. et al., T7 RNA polymerase. Prog Nucleic Acid Res Mol Biol. 2003;73:1-41.
Sousa, R., Use of T7 RNA polymerase and its mutants for incorporation of nucleoside analogs into RNA. Methods Enzymol. 2000;317:65-74.
Spooner, R.A. et al., DNA vaccination for cancer treatment. Gene Ther. May 1995;2(3):173-80.
Sproat, B.S., Chemistry and applications of oligonucleotide analogues. J Biotechnol. Jul. 31, 1995;41(2-3):221-38.
Staley, J.P. et al., Mechanical devices of the spliceosome: motors, clocks, springs, and things. Cell. Feb. 6, 1998;92(3):315-26.
Stanek, D. et al., Detection of snRNP assembly intermediates in Cajal bodies by fluorescence resonance energy transfer. J Cell Biol. Sep. 27, 2004;166(7):1015-25.
Steege, D.A., Emerging features of mRNA decay in bacteria. RNA. Aug. 2000;6(8):1079-90.
Steinman, R.M. et al., Dendritic cells: antigen presentation, accessory function and clinical relevance. Adv Exp Med Biol. 1993;329:1-9.
Steinman, R.M., The dendritic cell system and its role in immunogenicity. Annu Rev Immunol. 1991;9:271-96.
Stepinski, J. et al., Synthesis and properties of mRNAs containing the novel "anti-reverse" cap analogs 7-methyl(3'-O-methyl)GpppG and 7-methyl (3'-deoxy)GpppG. RNA. Oct. 2001;7(10):1486-95.
Sterner, D.E. et al, Acetylation of histones and transcription-related factors. Microbiol Mol Biol Rev. Jun. 2000;64(2):435-59.
Stiles, D.K., et al., Widespread suppression of huntingtin with convection-enhanced delivery of siRNA. Experimental Neurology. Jan. 2012; 233(1): 463-471.
Stinchcomb, D.T. et al., Isolation and characterisation of a yeast chromosomal replicator. Nature. Nov. 1, 1979;282 (5734):39-43.
Strong, V.T. et al., Incorporation of beta-globin untranslated regions into a Sindbis virus vector for augmentation of heterologous mRNA expression. Gene Ther. Jun. 1997;4(6):624-7.
Studier, F.W. et al., Use of bacteriophage T7 RNA polymerase to direct selective high-level expression of cloned genes. J Mol Biol. May 5, 1986;189(1):113-30.
Studier, F.W. et al., [6] Use of T7 RNA polymerase to direct expression of cloned genes. Methods Enzymol. 1990;185:60-89.
Su, Z. et al., Enhanced induction of telomerase-specific CD4(+) T cells using dendritic cells transfected with RNA encoding a chimeric gene product. Cancer Res. Sep. 1, 2002;62(17):5041-8.
Su, Z. et al., Immunological and clinical responses in metastatic renal cancer patients vaccinated with tumor RNA-transfected dendritic cells. Cancer Res. May 1, 2003;63(9):2127-33.
Suda, T. et al., Hydrodynamic gene delivery: its principles and applications. Mol Ther. Dec. 2007;15(12):2063-9. Epub Oct. 2, 2007.
Sullenger, B.A. et al., Emerging clinical applications of RNA. Nature. Jul. 11, 2002;418(6894):252-8.
Svinarchuk, F.P. et al., Inhibition of HIV proliferation in MT-4 cells by antisense oligonucleotide conjugated to lipophilic groups. Biochimie. 1993;75(1-2):49-54.
Takahashi, K., et al., Induction of pluripotent stem cells from mouse embryonic and adult fibroblast cultures by defined factors. Cell. Aug. 2006; 126(4): 663-76.
Takahashi, K., et al., Induction of pluripotent stem cells from adult human fibroblasts by defined factors. Cell. Nov. 2007; 131(5): 861-72.
Tam, C., et al., Cytokeratins mediate epithelial innate defense through their antimicrobial properties. J Clin Invest. Oct. 1, 2012; 122(10): 3665-3677.
Tanaka, M. et al., Inhibition of heart transplant injury and graft coronary artery disease after prolonged organ ischemia by selective protein kinase C regulators. J Thorac Cardiovasc Surg. May 2005;129(5):1160-7.
Tang, D.C. et al., Genetic immunization is a simple method for eliciting an immune response. Nature. Mar. 12, 1992;356(6365):152-4.
Tanguay, R.L. et al., Translational efficiency is regulated by the length of the 3' untranslated region. Mol Cell Biol. Jan. 1996;16(1):146-56.

(56) References Cited

OTHER PUBLICATIONS

Taranger, C.K. et al., Induction of dedifferentiation, genomewide transcriptional programming, and epigenetic reprogramming by extracts of carcinoma and embryonic stem cells. Mol Biol Cell. Dec. 2005;16(12):5719-35.
Tavernier, G., et al., mRNA as gene therapeutic: How to control protein expression. J. of Controlled Release. Mar. 2011; 150(3): 238-247.
Tazi, J. et al., Alternative chromatin structure at CpG islands. Cell. Mar. 23, 1990;60(6):909-20.
Teufel, R. et al., Human peripheral blood mononuclear cells transfected with messenger RNA stimulate antigen-specific cytotoxic T-lymphocytes in vitro. Cell Mol Life Sci. Aug. 2005;62(15):1755-62.
Thompson, M. et al., Nucleolar clustering of dispersed tRNA genes. Science. Nov. 21, 2003;302(5649):1399-401.
Thurner, B. et al., Vaccination with mage-3A1 peptide-pulsed mature, monocyte-derived dendritic cells expands specific cytotoxic T cells and induces regression of some metastases in advanced stage IV melanoma. J Exp Med. Dec. 6, 1999;190(11):1669-78.
Tourriere, H. et al., mRNA degradation machines in eukaryotic cells. Biochimie. Aug. 2002;84(8):821-37.
Towle, H.C. et al., Purification and characterization of bacteriophage gh-l-induced deoxyribonucleic acid-dependent ribonucleic acid polymerase from Pseudomonas putida. J Biol Chem. Mar. 10, 1975;250(5):1723-33.
Treat, J. et al., In Liposomes in the Therapy of Infectious Disease and Cancer, Lopez-Berestein and Fidler (eds.), Liss, New York, 1989. 353-65.
Trinchieri, G. et al., Cooperation of Toll-like receptor signals in innate immune defence. Nat Rev Immunol. Mar. 2007;7(3):179-90.
Trojan, A. et al., Immune reactivity against a novel HLA-A3-restricted influenza virus peptide identified by predictive algorithms and interferon-gamma quantitative PCR. J Immunother Jan.-Feb. 2003;26(1):41-6.
Tsuchiya, M, et al., Isolation and characterization of the cDNA for murine granulocyte colony-stimulating factor. Proc Natl Acad Sci USA. Oct. 1986; 83(20): 7633-7637.
Tung, T.C. et al., Organ formation caused by nucleic acid from different class.—Urodele DNA mediated balancer formation in goldfish. Sci Sin. Jan.-Feb. 1977;20(1):56-8.
Tung, T.C. et al., The effect of carp EGG-mRNA on the transformation of goldfish tail. Sci Sin. Jan.-Feb. 1977;20(1):59-63.
Tung, T.C. et al., Transmission of the nucleic acid-induced character, caudal fin, to the offspring in goldfish. Sci Sin. Mar.-Apr. 1975;18(2):223-31.
Tuting, T. et al., Gene-based strategies for the immunotherapy of cancer. J Mol Med (Berl). Jul. 1997;75(7):478-91.
Tycowski, K.T. et al., A small nucleolar RNA requirement for site-specific ribose methylation of rRNA in Xenopus. Proc Natl Acad Sci U S A. Dec. 10, 1996;93(25):14480-5.
Udenfriend, S., et al., The enzymatic conversion of phenylalanine to tyrosine. J. Biol. Chem. 1952; 194: 503-511.
Ueda, T. et al., Phosphorothioate-containing RNAs show mRNA activity in the prokaryotic translation systems in vitro. Nucleic Acids Res. Feb. 11, 1991;19(3):547-52.
Ulmer, J.B. et al., Heterologous protection against influenza by injection of DNA encoding a viral protein. Science. Mar. 19, 1993;259(5102):1745-9.
Ulmer, J.B., An update on the state of the art of DNA vaccines. Curr Opin Drug Discov Devel. Mar. 2001;4(2):192-7.
Utikal, J., et al., Immortalization eliminates a roadblock during cellular reprogramming into iPS cells. Nature. Aug. 2009; 460: 1145-1148.
Uzgun, S., et al., PEGylation improves nanoparticle formation and transfection efficiency of messenger RNA. Pharm Res. Sep. 2011; 28(9); 2223-2232.
Uzri, D. et al., Nucleotide sequences and modifications that determine RIG-I/RNA binding and signaling activities. J. Virol. May 2009; 83 (9): 4174-4184.

Vaheri, A. and Pagano, J.S. Infectious poliovirus RNA: a sensitive method of assay. Virology. Nov. 1965; 27(3): 434-436.
Valcarcel, J. et al., The protein Sex-lethal antagonizes the splicing factor U2AF to regulate alternative splicing of transformer pre-mRNA. Nature. Mar. 11, 1993;362(6416):171-5.
Van Den Bosch, G.A., et al., Simultaneous activation of Viral Antigen-specific Memory CD4+ and CD8+ T-cells using mRNA-electroporated CD40-activated autologous B-cells. J Immunother. Sep./Oct. 2006; 29, 512-23.
Van Gelder, R.N. et al., Amplified RNA synthesized from limited quantities of heterogeneous cDNA. Proc Nati Acad Sci U S A. Mar. 1990;87(5):1663-7.
Van Tendeloo, V.F. et al., Highly efficient gene delivery by mRNA electroporation in human hematopoietic cells: superiority to lipofection and passive pulsing of mRNA and to electroporation of plasmid cDNA for tumor antigen loading of dendritic cells. Blood. Jul. 1, 2001;98(1):49-56.
Van Tendeloo, V.F., et al., mRNA-based gene transfer as a tool for gene and cell therapy. Curr Opin Mol Therapeutics. 2007; 9(5): 423-431.
Vaquero, C. et al., Transient expression of a tumor-specific single-chain fragment and a chimeric antibody in tobacco leaves. Proc Natl Acad Sci U S A. Sep. 28, 1999;96(20):11128-33.
Varambally, S. et al., Genomic loss of microRNA-101 leads to overexpression of histone methyltransferase EZH2 in cancer. Science. Dec. 12, 2008;322(5908):1695-9. Epub Nov. 13, 2008.
Vassilev, V.B. et al., Microparticle-mediated RNA immunization against bovine viral diarrhea virus. Vaccine. Feb. 28, 2001;19(15-16):2012-9.
Mannick, J.A. et al., Transformation of Nonimmune Lymph Node Cells to a State of Transplantation Immunity by RNA. A Preliminary Report, Ann. Surg., 1962, 156:356-66.
Mansour, S.L. et al., Disruption of the proto-oncogene int-2 in mouse embryo-derived stem-cells: a general strategy for targeting mutations to non-selectable genes. Nature, 1988, 336:348-52.
Mansour, et al., Functional Studies with Uterine RNA. PNAS, 1965, 53:764-70.
Marson, A., et al., Wnt signaling promotes reprogramming of somatic cells to pluripotency. Cell Stem Cell. Aug. 2008; 3(2): 132-135.
Martin, S.A. et al., Purification of mRNA guanylyltransferase and mRNA (guanine-7-) methyltransferase from vaccinia virions. J Biol Chem. Dec. 25, 1975;250(24):9322-9.
Martinon, F. et al., Induction of virus-specific cytotoxic T lymphocytes in vivo by liposome-entrapped mRNA. Eur J Immunol. Jul. 1993;23(7):1719-22.
Massenet, S. et al., Pseudouridine mapping in the *Saccharomyces cerevisiae* spliceosomal U small nuclear RNAs (snRNAs) reveals that pseudouridine synthase pus1p exhibits a dual substrate specificity for U2 snRNA and tRNA. Mol Cell Biol. Mar. 1999;19(3):2142-54.
Mathers, A.R. et al., Professional antigen-presenting cells of the skin. Immunol Res. 2006;36(1-3):127-36.
Matray, T.J. et al., Synthesis and properties of RNA analogs-oligoribonucleotide N3'→P5' phosphoramidates. Nucleic Acids Res. Oct. 15, 1999;27(20):3976-85.
Maurer, N., et al., Spontaneous entrapment of polynucleotides upon electrostatic interaction with ethanol-destabilized cationic liposomes. Biophys J. May 2001; 80(5): 2310-2326.
Mayfield, S.P. et al., Expression and assembly of a fully active antibody in algae. Proc Natl Acad Sci U S A. Jan. 21, 2003;100(2):438-42. Epub Jan. 8, 2003.
McCafferty, J. et al., Phage antibodies: filamentous phage displaying antibody variable domains. Nature. Dec. 6, 1990;348(6301):552-4.
McCormack, A.L., et al., A-Synuclein suppression by targeted small interfering RNA in the primate substantia nigra. PLoS ONE. Aug. 2010; 5(8): e12122.
McCormack, M., et al., Activation of the T-cell oncogene LMO2 after gene therapy for X-linked severe combined immunodeficiency. N Engl J Med. Feb. 2004; 350: 913-922.
McDonald, J.D., et al., Characterization of mutations at the mouse phenylalanine hydroxylase locus. Genomics. 1997; 39: 402-405.

(56) References Cited

OTHER PUBLICATIONS

McElwee, K.J. et al., Transfer of CD8(+) cells induces localized hair loss whereas CD4(+)/CD25(−) cells promote systemic alopecia areata and CD4(+)/CD25(+) cells blockade disease onset in the C3H/HeJ mouse model. J Invest Dermatol. May 2005;124(5):947-57.
McGee, M., et al., The Quantitative determination of phenylalanine hydroxylase in rat tissues. Biochem. J. 1972; 127: 669-674.
McGlynn, R. et al., Differential subcellular localization of cholesterol, gangliosides, and glycosaminoglycans in murine models of mucopolysaccharide storage disorders. J Comp Neurol. Dec. 20, 2004;480(4):415-26.
McKenzie, B.S. et al., Nucleic acid vaccines: tasks and tactics. Immunol Res. 2001;24(3):225-44.
McLean, M.J., et al., Membrane differentiation of cardiac myoblasts induced in vitro by an RNA-enriched fraction from adult heart. Exp Cell Res. Nov. 1977;110(1):1-14.
MEGAscript Kit Product Manual, Ambion/Invitrogen website: http://tools.invitrogen.com/content/sfs/manuals/cms_072987.pdf, Publication Date: Oct. 27, 2009 (last accessed Mar. 17, 2013)("Ambion").
Mellits, K.H. et al., Removal of double-stranded contaminants from RNA transcripts: synthesis of adenovirus VA RNAI from a T7 vector. Nucleic Acids Res. Sep. 25, 1990;18(18):5401-6.
Meunier, L. et al, Heterogeneous populations of class II MHC+ cells in human dermal cell suspensions. Identification of a small subset responsible for potent dermal antigen-presenting cell activity with features analogous to Langerhans cells. J Immunol. Oct. 15, 1993;151(8):4067-80.
Mignone, F. et al., Untranslated regions of mRNAs. Genome Biol. 2002;3(3):REVIEWS0004. Epub Feb. 28, 2002. pp. 1-10.
Minks, M.A. et al., Structural requirements of double-stranded RNA for the activation of 2',5'-oligo(A) polymerase and protein kinase of interferon-treated HeLa cells. J Biol Chem. Oct. 25, 1979;254(20):10180-3.
Mishra, N.C. et al., Induction by RNA of inositol independence in Neurospora crassa. Proc. Natl Acad. Sci. U.S.A., 1975, 72(2):642-5.
Mishra, R.K. et al., Improved leishmanicidal effect of phosphorothioate antisense oligonucleotides by LDL-mediated delivery. Biochim Biophys Acta. Nov. 7, 1995;1264(2):229-37.
Mitchell, D.A. et al., RNA transfected dendritic cells as cancer vaccines. Curr Opin Mol Ther. Apr. 2000;2(2):176-81.
Mitchell, D.A. et al., RNA-transfected dendritic cells in cancer immunotherapy. J Clin Invest. Nov. 2000;106(9):1065-9.
Mitchell, P. et al., mRNA turnover. Curr Opin Cell Biol. Jun. 2001;13(3):320-5.
Miura, K., et al., Variation in the safety of induced pluripotent stem cell lines. Nat Biotechnology. Aug. 2009; 27(8): 743-745.
Morinaga, T. et al., Primary structures of human alpha-fetoprotein and its mRNA. Proc Natl Acad Sci U S A. Aug. 1983;80(15):4604-8.
Morse, M.A. et al., Generation of dendritic cells in vitro from peripheral blood mononuclear cells with granulocyte-macrophage-colony-stimulating factor, interleukin-4, and tumor necrosis factor-alpha for use in cancer immunotherapy. Ann Surg. Jul. 1997;226(1):6-16.
Mount, S.M. et al., A catalogue of splice junction sequences. Nucleic Acids Res. Jan. 22, 1982;10(2):459-72.
Muller, M.R. et al., Transfection of dendritic cells with RNA induces CD4- and CD8-mediated T cell immunity against breast carcinomas and reveals the immunodominance of presented T cell epitopes. J Immunol. Jun. 15, 2003;170(12):5892-6.
Murakawa, G.J. et al., Direct detection of HIV-1 RNA from AIDS and ARC patient samples. DNA. May 1988;7(4):287-95.
Myette, J.R. et al., Domain structure of the vaccinia virus mRNA capping enzyme. Expression in *Escherichia coli* of a subdomain possessing the RNA 5'-triphosphatase and guanylyltransferase activities and a kinetic comparison to the full-size enzyme. J Biol Chem. May 17, 1996;271(20):11936-44.

Nagata, S., et al., Molecular cloning and expression of cDNA for human granulocyte colony-stimulating factor. Nature. Jan. 30-Feb. 5, 1986; 319(6052): 415-8.
Nagata, S., et al., The chromosomal gene structure and two mRNAs for human granulocyte colony-stimulating factor. EMBO J. Mar. 1986; 5(3): 575-81.
Nagata, T. et al., Codon optimization effect on translational efficiency of DNA vaccine in mammalian cells: analysis of plasmid DNA encoding a CTL epitope derived from microorganisms. Biochem Biophys Res Commun. Aug. 2, 1999;261(2):445-51.
Nair, S. et al., Soluble proteins delivered to dendritic cells via pH-sensitive liposomes induce primary cytotoxic T lymphocyte responses in vitro. J Exp Med. Feb. 1, 1992;175(2):609-12.
Nair, S.K. et al., Antigen-presenting cells pulsed with unfractionated tumor-derived peptides are potent tumor vaccines. Eur J Immunol. Mar. 1997;27(3):589-97.
Nair, S.K. et al., Induction of cytotoxic T cell responses and tumor immunity against unrelated tumors using telomerase reverse transcriptase RNA transfected dendritic cells. Nat Med. Sep. 2000;6(9):1011-7.
Nair, S.K. et al., Induction of primary carcinoembryonic antigen (CEA)-specific cytotoxic T lymphocytes in vitro using human dendritic cells transfected with RNA. Nat Biotechnol. Apr. 1998;16(4):364-9.
Nakamura, K. et al., A model for the autosensitization autoantibody production associated with xenogeneic thymic RNA. J Immunol. Aug. 1978;121(2):702-9.
Nakamura, K. et al., Antigen restricted hybridization between antigen primed macrophage and thymic RNA. Immunol Commun. 1981;10(4-5):367-82.
Nakamura, K. et al., Conversion of immune response patterns from high to low and low to high by an RNase-sensitive thymocyte extract. Immunology. Sep. 1980;41(1):25-35.
Nakamura, K. et al., Generation of anti-NZB red blood cell antibody-forming plasma cells from bone marrow cultures of syngeneic and allogeneic mice: functional modulation of helper T-cell subsets in autosensitization. Immunology. Mar. 1983;48(3):579-86.
Nakamura, K. et al., Intranuclear incorporation of thymic low molecular weight RNA by murine bone marrow immunoblasts and inhibition of plasma cell formation by a derivative of rifampicin. Microbiol Immunol. 1982;26(1):41-57.
Nakamura, K. et al., Mechanism of anti-DNA antibody formation. The functional modulation of helper T-subset plays the key role in both murine and human B-cell autosensitization. Microbiol Immunol. 1986;30(7):703-15.
Iwase, Reiko et al., Molecular design of a eukaryotic messenger RNA and its chemical synthesis, Nucleic Acids Research, 1991, vol. 20, No. 7, pp. 1643-1648.
Squires, Jeffrey et al., Widespread occurrence of 5-methylcytosine in human coding an non-coding RNC, Nucleic Acids Research, 2012, vol. 40, No. 11, pp. 5023-5033.
Wyatt, et al., Occurrence of 5-Methyl-Cytosine in Nucleic Acid, 1950, vol. 166, No. 4214, pp. 237-238.
Chen, Chun et al., A Flexible RNA Backbone within the Polypyrimidine Tract is Required for U2AF65 Binding and Pre-mRNA Splicing In Vivo, Molecular and Cellular Biology, 2010, vol. 30, No. 17, pp. 4108-4119.
Wantabe, Hiroshi, et al., Conformational Stability and Warfarin-Binding Properties of Human Serum Albumin Studied by Recombinany Mutants, Biochem. J., 2001, vol. 357, No number, pp. 269-274.
Abramova, Tatyana, Frontiers and Approaches to Chemical Synthesis of Oligodeoxyribonucleotides, Molecules 2013, vol. 57, No. 18, 1063-1075.
Bain, J.D. et al., Regioselective ligation of oligoribonucleotides using DNA Splints, Nucleic Acids Research, vol. 20, No. 16, p. 4372.
Bonora, G. et al., HELP (High Efficiency Liquid Phase) new oligonucleotide synthesis on soluble polymeric support, Oxford Journals Life Sciences Nucleic Acids Research vol. 18, Issue 11 pp. 3155-3159.

(56) References Cited

OTHER PUBLICATIONS

Borovkov, A. et al., High-Quality Gene Assembly Directly From Unpurified Mixtures of Microarray-Synthesized Oligonucleotides, Nucleic Acids Research, 2010, vol. 38, No. 19, pp. e180 1-10.

Cheng, S. et al. Effective Amplification of Long Targets From Cloned Inserts and Hunam Genomic DNA, Proc. Nati. Acad. Sci. USA,1994, vol. 91, pp. 5695-5699.

Cleary, Michele et al., Production of Complex nucleic acid libraries using highly parallel in situ oligonucleotide synthesis, 2004, Nature Methods vol. 1 No. 3, Dec. 2004, pp. 241-248.

El-Sagheer, Afaf H. et al., Click Nucleic Acid Ligation: Applications in Biology and Nanotechnology, Accounts of Chemical Research, 2012 vol. 45, No. 8, pp. 1258-1267.

Freeman, Willard M. et al., Quantitative RT-PCR: Pitfalls and Potential, BioTechniques, 1999, vol. 26, No. 1, pp. 112-125.

Gibson, D. et al., Creation of a Bacterial Cell Controlled by a Chemically Synthesized Genome, Science, 2010, vol. 329, No. 52, pp. 51-56.

Gibson, Daniel G., Chemical Synthesis of the Mouse Mitochondrial Genome, Nature Methods , vol. 7., No. 11 Nov. 2010, pp. 901-905.

Goodchild, John et al., Conjugates of Oligonucleotides and Modified Oligonucleotides: A Review of Their Synthesis and Properties, Bioconjugate Chemistry, 1990, vol. 1., No. 3., pp. 165-187.

Innis, M., DNA Sequencing with Thermus Aquaticus DNA Polymerase and Direct Sequencing of Polymerase Chain Reaction-Amplified DNA, Proc. Natl. Acad. Sci. USA, 1988, vol. 85, pp. 9436-9440.

Kang, Hyunmin, Inhibition of MDR1 Gene Expression by Chimeric HNA Antisense Oligonucleotides, Nucleic Acids Research, 2004, vol. 32, No. 14, pp. 4411-4419.

Lavrik, Irina N. et al., Translational Properties of mHNA, a Messenger RNA Containing Anhydrohexitol Nucleotides, Biochemistry 2001, vol. 40, No. 39, pp. 11777-11784.

Li, Junjie, et al., Methylation Protects miRNAs and siRNAs from a 3_-End Uridylation Activity in Arabidopsis, Current Biology, 2005, vol. 15, (no number), pp. 1501-1507.

Lizardi, PM., et al., Mutation Detection and Single-Molecule Counting Using Isothermal Rolling-Circle Amplification, Nat Genetics, 1998, vol. 19, No #, pp. 225-232.

Martinelli, Richard A., Chemiluminescent Hybridization-Ligation Assays for F508 and I507 Cystic Fibrosis Mutations, Clinical Chemistry, 1996, vol. 42., No. 1, pp. 14-18.

Moore, M., Site-Specific Modification of Pre-mRNA: the 2"-Hydroxyl Groups at the Splice Sites, Science, 1992, vol. 256, No #, pp. 992-997.

Nagata, S., Synthesis and Biological Activity of Artificial mRNA Prepared with Novel Phosphorylating Reagents, Nucleic Acids Research, 2010, vol. 38, No. 21, pp. 7845-7857.

Norbury, Chris J., Cytoplasmic RNA: A Case of the Tail Wagging the Dog, Nature Reviews, Molecular Cell Biology, 2013, Advanced Online Publication, No Volume Number, pp. 1-10.

Nwe, K. et al., Growing Applications of "Click Chemistry" for Bioconjugation in Contemporary Biomedical Research, Cancer Biotherapy and Radiopharmaceuticals, 2009, vol. 24., No. 3., pp. 289-301.

Ochman, H., Genetic Applications of an Inverse Polymerase Chain Reaction, Genetics, Washington University School of Medicine, 1988, vol. 120, No #, pp. 621-623.

Polidoros, A. et al., Rolling Circle Amplification-RACE: a method for Simultaneous Isolation of 5" and 3" cDNA ends from Amplified cDNA templates, Benchmarks, Biotechniques, 2006, vol. 41, No. 1, pp. 35-42.

Pon, R., Multiple Oligodeoxyribonucleotide Syntheses on a Reusable Solid-Phase CPG Support Via the Hydroquinone-O, O"-diacetic acid (Q-Linker) linker arm, Nucleic Acids Research, 1999, vol. 27, No. 6, pp. 1531-1538.

Shiba, Y. et al., Chemical Synthesis of a Very Long Oligoribonucleotide with a 2-cyanoethoxymethyl (CEM) as the 2'-O-protecting Group: Structural Identification and Biological Activity of a Synthetic 110mer precursor-microRNA Candidate, Nucleic Acids Research, 2007, vol. 35, No. 10, pp. 3287-3296.

Sindelar, L. et al., High-throughput DNA Synthesis in a Multichannel Format, Nucl. Acids Res. 1995, vol. 23, No. 6, pp. 982-987.

Stark, M. et al., An RNA Ligase-mediated Method for the Efficient Creation of Large, Synthetic RNAs, Method, 2006, vol. 12, No vol. number, pp. 2014-2019.

Walker, T., Isothermal In Vitro Amplification of DNA by a Restriction Enzyme/ DNA Polymerase System, Proc. Natl. Acad. Sci. USA, 1992, vol. 89, No number, pp. 392-396.

Zhu, B., Syn5 RNA Polymerase Synthesizes Precise Run-Off RNA Products, Nucleic Acids Research, 2013, vol. 103, No #, pp. 1-10.

Prokazyme Ltd., ThermoPhage, ssDNA ligase,2013, No vol. pp. 1-3.

PROKARIA LTD, Tsc DNA ligase, 2013, No vol., pp. 1-3.

Bolhassani A., et al. , Improvement of Different Vaccine Delivery Systems for Cancer Therapy, Molecular Cancer, Biomed Central, London, GB, 2011, vol. 10, No. 3, pp. 1-20.

Cheng, Ee-chun et al., Repressing the Repressor: A lincRNA as a MicroRNA Sponge in Embryonic Stem Cell Self-Renewal, Developmental Cell, 2013, vol. 25, No number, pp. 1-2.

Memczak, Sebastian et al. , Circular RNAs are a large class of animal RNAs with Regulatory Potency, Nature, 2013, vol. 495, No number, pp. 333-343.

Hentze, M., Circular RNAs: Splicing's Enigma Variations, The EMBO Journal, 2013, vol. 32, no number, pp. 923-925.

Ledford, Heidi et al, Circular RNAs Throw Genetics for a Loop, In Focus News, Nature, vol. 494, pp. 291-292.

Salzman, Julia et al., Circular RNAs are the Predominant Transcript Isoform From Hundreds of Human Genes in Diverse Cell Types, PLOS One, 2012, vol. 7, Issue 2, pp. 1-12.

Ebert, Margaret S., MicroRNA sponges: Competitive Inhibitors of Small RNAs in Mammalian Cells, Nature Methods, 2007, vol. 4, No. 9, pp. 721-726.

Jeck, William et al. Circular RNAs Are Abundant, Conserved, and Associated with ALU Repeats, RNA, 2013, vol. 19, pp. 141-157.

Matsuda, V. et al., Determinants of Initiation Codon Selection During Translation in Mammalian Cells, PLOS One, 2010, vol. 5, Issue 11, pp. 1-13.

Mukherji, S. et al., MicroRNAs Can Generate Thresholds in Target Gene Expression, Nature Genetics, 2011, vol. 43, No. 9, pp. 854-860.

Hansen, Thomas et al., Natural RNA Circles Function as Efficient MicroRNA Sponges, Nature, 2013, vol. 495, no number, pp. 384-390.

Rose, Jason, MicroRNA "Sponge": Proof of Concept for a Novel MicroRNA Target Identification Technique, A Major Qualifying Project Report, Submitted to the Faculty of Worcester Polytechnic Institute, 2010, No Volume, pp. 1-26.

Touriol, C. et al., Generation of Protein Isoform Diversity by Alternative Initiation of Translation at Non-AUG Codons, Biology of the Cell, 2003, vol. 95, no number, pp. 168-178.

Wang et al., Endogenous miRNA Sponge lincRNA-RoR Regulates Oct4, Nanog, and Sox2 in Human Embryonic Stem Cell Self-Renewal, Developmental Cell, 2013, vol. 25, No #, pp. 69-80.

WHO Drug Information, International Nonproprietary Names for Pharmaceutical Substances (INN), 1993, vol. 7, No. 4, pp. 1-16.

Eli Lilly and Company, ReoPRo, Abciximab, Product Label, 2005, No volume number, pp. 1-4.

Kempeni, Joachim et al., Preliminary Results of Early Clinical Trials with the Fully Human Anti-TNFa Monoclonal Antibody D2E7, Ann Rheum Dis, 1999, vol. 58, Supp I, pp. 170-172.

Lindner, Heidrun et al., Peripheral Blood Mononuclear Cells Induce Programmed Cell Death in Human Endothelial Cells and May Prevent Repair: Role of Cytokines, 1997, vol. 89, No. 6, pp. 1931-1938.

Crowe, J.S. et al., Humanized Monoclonal Antibody CAMPATH-1H Myeloma Cell Expression of Genomic Constructs, Nucleotide Sequence of cDNA Constructs and Comparison of Effector Mechanisms of Myeloma and Chinese Hamster Ovary Cell-Derived Material, Clinical Exp. Immunol., 1992, vol. 87, No number, pp. 105-110.

(56) References Cited

OTHER PUBLICATIONS

Ferrara, James et al., Graft-versus Host Disease, Lancet, 2009, vol. 373, No. 9674, pp. 1550-1561.
Hale, G. et al., Removal of T Cells From Bone Marrow for Transplantation: a Monoclonal Antilyphocyte Antibody That Fixes Human Complement, Blood, 1983, vol. 62, No. 4, pp. 873-882.
Lutz, Riechmann et al., Reshaping Human Antibodies for Therapy, Nature,1988, vol. 332, No. 24 , pp. 323-327.
Novartis, Product Label, Simulect, Basiliximab, 1998, No vol. pp. 1-7.
Baker, Kevin P. et al., Generation and Charaterization of LymphonStat-B, a Human Monoclonal Antibody That Antagonizes the Bioactivities of B Lymphocyte Stimulator, Arthritis & Rheumatism, 2003, vol. 48, No. 11, pp. 3253-3265.
ADIS R&D Profile, Belimumab, Drugs R D, 2010; vol. 10 , No. 1, pp. 55-65.
AVASTIN, Bevacizumab, Labeling Text, 2013, No Volume, pp. 1-27.
Chen, Helen et al., Expanding the Clinical Development of Bevacizumab, The Oncologist, 2004, vol. 9, Supp 1, pp. 27-35.
Herbst, Roy et al., Non-Small Cell Lung Cancer and Antiangiogenic Therapy: What Can Be Expected pf Bevacizumab?, The Oncologist, 2004, vol. 9 Supp. 1, pp. 19-26.
Presta, Leonard G. et al., Humanization of Anti-Vascular Endothelial Growth Factor Monoclonal Antibody for the Therapy of Solid Tumors and Other Disorders, Cancer Research, 1997, vol. 57, pp. 4593-4599.
Bowen, Michael et al., Functional Effects of CD30 on a Large Granular Lymphoma Cell Line, YT, The Journal of Immunology, 1993, vol. 151, No. 11, pp. 1-11.
ADCETRIS, brentuximab vedotin, Product Label, 2011,No Volume, pp. 1-15.
Francisco, Joseph et al., cAc10-vcMMAE, an Anti-CD30-monomethyl Auristatin E Conjugate with Potent and Selective Antitumor Activity, Blood, 2003,vol. 102, No. 4, pp. 1458-1465.
Wahl Alan F. et al, The Anti-CD30 Monoclonal Antibody SGN-30 Promotes Growth Arrest and DNA Fragmentation in Vitro and Affects Antitumor Activity in Models of Hodgkins's Disease, Cancer Research, 2002, vol. 62, pp. 3737-3742.
Alten, Rieke et al., The Human Anti-IL-1β Monoclonal Antibody ACZ885 is Effective in Joint Inflammation Models in Mice and in a Proof-of-Concept Study in Patients with Rheumatoid Arthritis, Arthritis Research & Therapy, 2008, vol. 10, No. 3, pp. 1-9.
Canakinumab FDA Label, 2009, No Volume # pp. 1-11.
Church, L et al. , Canakinumab, a Fully Human mAB Against IL-1β for the Potential Treatment of Inflammatory Disorder, Current Opinion in Molecular Therapeutics, 2009, vol. 11, No. 1, pp. 81-89.
Lachmann, Helen et al., In Vivo Regulation of Interleukin 1β in Patients With Cryopyrin-Associated Periodic Syndromes, The Journal of Experimental Medicine, 2008, vol. 206, No. 5, pp. 1029-1036.
Lachmann, Helen et al., Use of Canakinumab in the Cryopyrin-Associated Periodic Syndrome, The New England Journal of Medicine, 2009, vol. 360, No. 23, pp. 2416-2425.
Rowe, William S. et al., Update on the Pathogenesis and Treatment of Systemic Idiopathic Arthritis, Curr. Opinion Pediat, 2011, vol. 23, No. 6, pp. 640-646.
Wells, Michael J. et al,. Pathophysiology and Clinical Implications of Pulmonary Arterial Enlargement in COPD, International Journal of COPD, 2013, vol. 8, No number, pp. 509-521.
ImClone Systems Incorporated and Bristol-Myers Squibb Company, ERBITUX, Cetuximab, 2004, No. vol. number, pp. 1-18.
Goldstein, N et al., Biological Efficacy of a Chimeric Antibody to the Epidermal Growth Factor Receptor in a Human Tumor Xenograft Model, Clinical Cancer Research, 1995, vol. 1, No number, pp. 1311-1318.
Mendelsohn, J. et al, Epidermal Growth Factor Receptor Inhibition by a Monoclonal Antibody as Anticancer Therapy, 1997, vol. 3 No #, pp. 2703-2707.
Xiang, Bo et al., Colorectal Cancer Immunotherapy, Discovery Medicine, 2013, No vol., pp. 1-8.
Chapman, Andrew et al., Therapeutic Antibody Fragments With Prolonged in Vivo Half-Lives, Nature America Inc., 1999, vol. 17, No Number, pp. 780-783.
Choy et al, Efficacy of a Novel PEGylated Humanized Anti-TNF Fragment (CDP870) in patients with Rheumatoid Arthritis: A phase II double-blinded, randomized, Dose-Escalating Trial, Rheumatology 2002; vol. 41, No number, pp. 1133-1137.
CIMZIA, Product Label, Reference ID: 3217327, UCB, Inc., 2008, No. vol. #, pp. 1-26.
Goel, N. et al, Certolizumab pegol, mABS, 2010, vol. 2, No. 2, pp. 137-147.
Mease, PJ et al., Effect of certolizumab pegol on signs and symptoms in patients with psoriatic arthritis: 24-week results of a Phase 3 double-blind randomized placebo-controlled study (RAPID-PsA), Ann Rheum Dis, 2014, vol. 73, No #, pp. 48-55.
Queen, C et al., A humanized antibody that binds to the interleukin 2 receptor, Proc. Natl. Acad. Sci. USA, 1989, vol. 86, pp. 10029-10033.
Jaffers, Gregory et al, Monoclonal Antibody Therapy, Transplantation, 1986, vol. 41, No. 5, pp. 572-578.
Ortho Multicenter Transplant Study Group, A Randomized Clinical Trial of OKT3 Monoclonal Antibody for Acute Rejection of Cadaveric Renal Transplants, The New England Journal of Medicine, 1985, vol. 313, No. 6, pp. 337-342.
Roche, Zenapax (daclizumabl) Sterile Concentrate for Injection,2013, No vol., pp. 1-11.
Bekker, Pirow et al., The Effect of a Single Dose of Osteoprotegerin in Postmenopausal Women, Journal of Bone and Mineral Research, 2001, vol. 16, No. 2, pp. 1-13.
Bekker, Prow et al., A single-Dose Placebo-Controlled Study of AMG 162, a Fully Human Monoclonal Antibody to RANKL, in Postmenopausal Women, Journal of Bone and Mineral Research, 2004, vol. 19, No. 7, pp. 1-8.
Body, Jean-Jacques et al., A Study of the Biological Receptor Activator of nuclear Factor-KappaB Ligand inhibitor, Denosumab, in patients with multiple myeloma or bone metastases from Breast Cancer, Clinical Cancer Research, 2006, vol. 12, No #, pp. 1221-1228.
Westenfeld, Ralf et al., Anti-RANKL therapy—implications for the bone-vascular-axis in CKD? Denosumab in postmenopausal women with low bone mineral density, Nephrol Dial Transplant, 2006, vol. 21, pp. 2075-2077.
Xgeva (denosumab) Product Label 2010-2013 pp. 1-16.
Hillmen, Peter et al., Effect of Eculizumab on Hemolysis and Transfusion Requirements in Patients with Paroxysmal Nocturnal Hemoglobinuria, The New England Journal of Medicine, 2004, vol. 350, No. 6, pp. 552-559.
Ministry of Health, Labour and Welfare, Report on the Deliberation Results, Soliris for Intravenous Infusion 300 mg, 2010, No vol., pp. 1-105.
Golimumbab—Product Label—Janssen Biotech, Inc., 2013, No Volume number, pp. 1-19.
Garcia, Maria et al., Patient Consideration in the Management of Rheumatoid Arthritis: Role of Once-A-Month Golimumab Injection, Clinical Medical Insights: Therapeutics, Libertas Academica, 2011, vol. 3, No #, pp. 415-423.
Mazumdar, Sohini et al., Golimumab, mAbs, 2009, vol. 1, No. 5, pp. 422-431.
Shealy, David et al., Characterization of Golimumab, A Human Antibody Specific for Human Tumor Necrosis Factor α, mAbs, 2010, vol. No. 2, No. 4, pp. 428-439.
Hainsworth, John, Monoclonal Antibody Therapy in Lymphoid Malignancies, The Oncologist, 2000, vol. 5, No #, pp. 376-384.
FDA Label, Ibritumomab Tiuxetan, ZEVALIN, 2001, IDEC Pharmaceuticals Corporation, No vol. pp. 1-38.
Wagner, Henry et al., Admiration Guidelines for Radioimmunotherapy of Non-Hodgkin's Lymphoma with 90Y-Labeled Anti-CD20 Monoclonal Antibody, 90Y Radioimmunotherapy Administration, The Journal of Nuclear Medicine, 2002, vol. 43, No. 2, pp. 267-272.

(56) References Cited

OTHER PUBLICATIONS

WHO Drug Information, International Nonproprietary Names for Pharmaceutical Substances (INN), Recommended INN, 2000, vol. 14, No. 1, pp. 39-76.
Fellner, Christopher et al., Ipilimumab (Yervoy) Prolongs Survival in Advanced Melanoma, Drug Forecast, 2012, vol. 37, No. 9, pp. 503-530.
Hooks, Michael et al., Muromonab CD-3: A Review of Its Pharmacology, Pharmacokinetics, and Clinical Use in Transplantation, Pharmacotherapy, 1991, vol. 11, No. 1, pp. 26-37.
FDA Guide, TYSABRI, Elan Pharmaceuticals, Inc., Reference ID: 3308057, Biogen Idec, Inc. 2013, No Volume #, pp. 1-6.
Gordon, F.H., A Pilot Study of Treatment of Active Ulcerative Colitis With Natalizumab, a Humanized Monoclonal Antibody to Alpha-4 Integrin, Aliment Pharacol Ther, 2002, vol. 16, No #, pp. 699-705.
Guagnozzi, Danila etal, Natalizumab in the Treatment of Crohn's Disease, Biologics: Targets & Therapy, 208, vol. 2, No. 2, pp. 275-284.
Nicholas, J et al., New and Emerging Disease-Modifying Therapies for Relapsing-Remitting Multiple Sclerosis: What is New and What is to Come, Journal of Central Nervous System Disease, 2012, vol. 4, No#, pp. 81-103.
Minagar, Alireza et al., Current and Future Therapies for Multiple Sclerosis, Scientifica, 2012, vol. 2013, Artible ID 249101, pp. 1-11.
Cong, Shundong et al., Novel CD20 Monoclonal Antibodies for Lymphoma Therapy, Journal of Hematology & Oncology, 2012, vol. 5, No. 64, pp. 1-9.
FDA Label, ARZERRA, Prescribing Info, 2009, GlaxoSmithKline, No. vol., pp. 1-13.
Issa, Ghayas et al., Movel Agents in Waldenstrom Macroglobulinemia, Clin Investig, 2011, vol. 1, No. 6, pp. 815-824.
Jaglowski, Samantha et al., The clinical application of monoclonal antibodies in chronic lymphocytic leukemia, Blood, 2010, vol. 116, No #, pp. 3705-3714.
Rosman, Ziv et al., Biologic Therapy for Autoimmune Diseases: an update, BMC Medicine, 2013, vol. 11 No. 88 pp. 1-12.
Teeling, Jessica et al., Characterization of New Human CD20 Monoclonal Antibodies with Potent Cytolytic Activity Against Non-Hodgkin Lymphomas, Blood, 2004, vol. 104, No#, pp. 1793-1800.
Teeling, Jessica et al., The Biological Activity of Human CD20 Monoclonal Antibodies is Linked to Unique Epitopes on CD20, The Journal of Immunology, 2006, vol. 177, No #, pp. 362-371.
Zhang, Bodi et al., Ofatumumab, mAbs, 2009, vol. 1, No. 4, pp. 326-331.
Vichyanond, Pakit et al., Omalizumab in allergic diseases, a recent review, Asian Pac J Allergy Immunol, 2011, vol. 29, No #, pp. 209-219.
Thomson, Neil et al, Circulatory, Respiratory and Pulmonary Medicine, Clinical Medicine Insights, 2012, vol. 6, No #, pp. 27-40.
FDA, Medication Guide XOLAIR, (omalizumab), 2013, No vol. pp. 1-2.
Biopharma, Sample Synagis, MedImmune, Inc., 2013, No vol. pp. 1-19.
FDA Label—SYNAGIS® (PALIVIZUMAB)—1999, MedImmune, Inc., No. vol. pp. 1-7.
Huang, Kelly et al., Respiratory Syncytial Virus-Neutralizing Monoclonal Antibodies Motavizumab and Palivizumab Inhibit Fusion, Journal of Virology, Aug. 2010, vol. 84, No. 16, pp. 8132-8140.
FDA Label—Vectibix® (panitumumab), Amgen Inc., 2006-2008, No vol. , pp. 1-13.
Grunwalk, Viktor et al., Developing Inhibitors of the Epidermal Growth Factor Receptor for Cancer Treatment, Journal of the National Cancer Institute, 2003, vol. 95, No. 12, pp. 851-867.
Yang, Xiao-Dong et al., Eradication of Established Tumors by a Fully Human Monoclonal Antibody to the Epidermal Growth Factor Receptor without Concomitant chemotherapy, Cancer Research, 1999, vol. 59, No. #, pp. 1236-1243.
Yang, Xiao-Dong et al., Development of ABX-EGF, A Fully Human anti-EGF Receptor Monoclonal Antibody, for Cancer Therapy, Oncology Hematology, 2001, vol. 38, No. #, pp. 17-23.
FDA, Highlights of Prescribing Information LUCENTIS(ranibizumab injection), Genentech, Inc., 2006, No vol., pp. 1-9.
Binder, Mascha et al., The Epitope Recognized by Rituximab, Blood, 2006, vol. 108, No. 6, pp. 1975-1978.
FDA Label, Rituxan, Rituximab, IDEC Pharmaceuticals Corporation and Genetech, Inc., No vol. #, pp. 1-2.
FDA Label, ACTEMRA (tocilizumab) , Risk Evaluation and Mitigation Strategy (REMS) 2013, Genentech, Inc., Reference ID: 3394610, No vol. #, pp. 1-53.
FDA Label, BEXXAR, Tositumomab and Iodine | 131 Tositumomab 2003, Corixa Corp. and GlaxoSmithKline, No vol. #, pp. 1-49.
Srinivasan, A. et al., Tositumomab and Iodine | 131 Tositumomab Bexaar, Pharmacology Vignette, 2011, vol. 32 , No #, pp. 637-638.
FDA Guide, Herceptin (trastuzumab), Highlights of Prescribing Information, 2010, Genentech, Inc., pp. 1-33.
European Public Assessment Report (EPAR), REMOVAB, European Medicines Agency, 2009, No vol. # pp. 1-2.
Ruf, P. et al., Characterization of the New EpCAM-specific antibody HO-3: Implications for Trifunctional Antibody Immunotherapy of Cancer, British Journal of Cancer, 2007, vol. 97, No. 3, pp. 351.321.
Chelius, Dirk et al., Structural and functional characterization of the trifunctional antibody catumaxomab, mAbs, 2010, vol. 2 No. 3, pp. 309-319.
Linke, Rolf et al., Catumazomab Clinical Development and Future Directions, Landes Bioscience, mAbs, vol. 2, No. 2, pp. 129-136.
McLean, Leon et al., Vedolizumab for the treatment of ulcerative colitis and Crohn's disease, Immunotherapy, 2012, vol. 4, No. 9, pp. 883-898.
Reichert, Janice M. et al., Which Are the Antibodies to Watch in 2013, mAbs, 2013, vol. 5, No. 1, pp. 1-4.
Rob C. et al., IgG4 Breaking the Rules, Immunology, 2002, vol. 105, No #, pp. 9-19.
Alexandrakis, Michael et al., Relationship Between Circulating BAFF Serum Levels with Proliferating Markers in Patients with Multiple Myeloma, Biomed Research International, 2013, vol. 2013, Article ID. 389579, pp. 1-7.
Alfonso, Mauro et al., An Anti-Idiotype Vaccine Elicits a Specific Response to N-Glycolyl Sialic Acid Residues of Glycoconjugates in Melanoma Patients, The Journal of Immunology, 2002, vol. 168, No # , pp. 3523-2529.
Alonso, Ruby et al., Towards the Definition of a Chimpanzee and Human Conserved CD6 Domain 1 Epitope Recognized by T1 Monoclonal Antibody, Hybridoma, 2008, vol. 27, No. 4, pp. 291-301.
ALPROLIX, Highlights of Prescribing Information, Full Prescribing Information, Biogen Idec,2013, No vol., pp. 1-19.
David McAuley, Pharm.D., Alzheimer's Disease—Therapeutic agents, 2012, No vol. #, pp. 1-3.
Angevin, Eric et al., A Phase I/II, Multiple-Dose, Dose-Escalation Study of Siltuximab, an Anti-Interleukin-6 Monoclonal Antibody, in Patients with Advanced Solid Tumors, Clinical Cancer Research, 2014, vol. 20, No. 8, pp. 1-14.
Micromedex, Antihemophilic Factor Viii and Von Willebrand Factor Complex (Intravenous Route) , Mayo Clinic, No. vol. #, pp. 1-3.
Armstrong, Deborah, et al., Farletuzumab (MORAb-003) in platinum-sensitive ovarian cancer patients experiencing a first relapse, Community Oncology, 2010, vol. 7, No. 2, Supp 1., pp. 1-4.
Baeten, Dominique et al., Anti-interleukin-17A monoclonal antibody secukinumab in treatment of ankylosing spondylitis: a randomised, double-blind, placebo-controlled trial, The Lancet, 2013, vol. 382, No #, pp. 1705-1713.
Bai, D.L. et al., Huperzine A, A Potential Therapeutic Agent for Treatment of Alzheimer's Disease, Current Medicinal Chemistry, 2000, vol. 7, No. 3, pp. 355-374.
Ballatore, Carlo et al., Microtubule Stabilizing Agents as Potential Treatment for Alzheimer's Disease and Related Neurodegenerative Tauopathies, J. Med Chem., 2012, vol. 55, No. 21, pp. 8979-8996.

(56) References Cited

OTHER PUBLICATIONS

Barker, Edward, et al., Effect of a Chimeric Anti-Ganglioside GD2 Antibody on Cell-mediated Lysis of Human Neuroblastoma Cells, Cancer Researchm, 1991, vol. 51, No. #, pp. 144-149.
Bamias, Giorgos, et al., Leukocyte Traffic Blockage in Inflammatory Bowel Disease, Current Drug Targets, 2013, vol. 14, No. 12, pp. 1490-1500.
Blom, Dirk J. et al., A 52-Week Placebo-Controlled Trial of Evolocumab in Hyperlipidemia, The New England Journal of Medicine, 2014, No. vol. #, pp. 1-11.
Bococizumab, Statement on a Nonproprietary Name Adopted by the USAN Council, 2013, No vol. pp. 1-2.
Bohrmann, Bernd et al., Gantenerumab: A Novel Human Anti-Aβ Antibody Demonstrates Sustained Cerebral Amyloid-β Binding and Elicits Cell-Mediated Removal of Human Amyloid-β, Journal of Alzheimer's Disease, 2012, vol. 28, No. #, pp. 49-69.
Borghaei, Hossein et al., Phase I Dose Escalation, Pharmacokinetic and Pharmacodynamic Study of Naptumomab Estafenatox Alone in Patients With Advanced Cancer and With Docetaxel in Patients With Advanced Non-Small-Cell Lung Cancer, Journal of Clinical Oncology, 2009, vol. 27, No. 25, pp. 4116-4123.
Bottero, Federica et al., GeneTransfection and Expression of the Ovarian Carcinoma Marker Folate Binding Protein on NIH/3T3 Cells Increases Cell Growth in Vitro and in Vivo, Cancer Research, 1993, vol. 53, No. #, pp. 5791-5796.
Bousquet, Jean MD et al, Eosinophilic Inflammation in Asthma, The New England Journal of Medicine, 1990, vol. 323, No. 15, pp. 1033-1039.
Burgess, Teresa et al., Biochemical Characterization of AMG 102: A Neutralizing, Fully Human Monoclonal Antibody to Human and Nonhuman Primate Hepatocyte Growth Factor, Molecular Cancer Therapeutics, 2010, vol. 9, No. 2, pp. 400-409.
Busse, William W. et al., Safety profile, pharmacokinetics, and biologic activity of MEDI-563, an anti-IL-5 receptor a antibody, in a phase I study of subjects with mild asthma, J Allergy Clin Immunol, 2010, vol. 125, No. 6, pp. 1237-1244.
Carnahan, Josette et al., Epratuzumab, a Humanized Monoclonal Antibody Targeting CD22 Characterization of in Vitro Properties, Clinical Cancer Research, 2009, vol. 9, No. #, pp. 1-8.
Castro, Mario et al., Reslizumab for Poorly Controlled, Eosinophilic Asthma, A Randomized, Placebo-controlled Study, American Journal of Respiratory and Critical Care Medicine, 2011, vol. 184, No#, pp. 1125-1132.
Cavelti-Weder, Claudia et al., Effects of Gevokizumab on Glycemia and Inflammatory Markers in Type 2 Diabetes, Diabetes Care, 2012, vol. 35, No number, pp. 1654-1662.
Chou, Hsun-Hua et al., A mutation in human CMP-sialic acid hydroxylase occurred after the Homo-Pan divergence, Proc. Natl. Acad. Sci. USA,1998, vol. 95, No #, pp. 11751-11756.
Grundy, Scott et al., Promise of Low-Density Lipoprotein-Lowering Therapy for Primary and Secondary Prevention, Circulation Journal of the American Heart Association, 2008, vol. 117, No #, pp. 569-573.
Raal, Frederick et al., Low-Density Lipoprotein Cholesterol-Lowering Effects of AMG 145, a Monoclonal Antibody to Proprotein Convertase Subtilisin/Kexin Type 9 Serine Protease in Patients With Heterozygous Familial Hypercholesterolemia: The Reduction of LDL-C With PCSK9 Inhibition in Heterozygous Familial Hypercholesterolemia Disorder (RUTHERFORD) Randomized Trial, Circulation, 2012, vol. 126, pp. 2408-2417.
Roche Pharma AG, A Study to Evaluate Two Doses of Ocrelizumab in Patients With Active Systemic Lupus Erythematosus (BEGIN), ClinicalTrials.gov, Apr. 1, 2014, No vol. #, http://clinicaltrials.gov/ct2/show/NCT00539838, pp. 1-4.
Genentech, A Study of the Efficacy and Safety of Ocrelizumab in Patients With Relapsing-Remitting Multiple Sclerosis, ClinicalTrials.gov, Apr. 1, 2014, http://clinicaltrials.gov/ct2/show/NCT00676715, pp. 1-3.
Morphotek, Efficacy and Safety of MORAb-003 in Subjects With Platinum-sensitive Ovarian Cancer in First Relapse, ClinicalTrials. gov, Apr. 2, 2014, http://clinicaltrials.gov/ct2/show/NCT00849667?term=Farletuzumab&rank=4&submit_fld_opt, pp. 1-3.
Roche Pharma AG, A Study to Investigate the Efficacy and Safety of Bendamustine Compared With Bendamustine +R05072759 (GA101) in Patients With Rituximab-Refractory, Indolent Non-Hodgkin's Lymphoma (GADOLIN), ClinicalTrials.gov, Apr. 2, 2014, http://clinicaltrials.gov/ct2/show/NCT01059630?term=Obinutuzumab&rank=20&submit_fld_opt, pp. 1-3.
Eli Lilly and Company, A Study of Ramucirumab (IMC-1121B) Drug Product (DP) and Best Supportive Care (BSC) Versus Placebo and BSC as 2nd-Line Treatment in Patients With Hepatocellular Carcinoma After 1st-Line Therapy With Sorafenib (REACH), ClinicalTrials.gov , Apr. 2, 2014, http://clinicaltrials.gov/ct2/show/NCT01140347?term=ramucirumab&rank=12&submit_fld_opt, pp. 1-4.
Eli Lilly and Company, A Study of Chemotherapy and Ramucirumab vs. Chemotherapy Alone in Second Line Non-small Cell Lung Cancer Participants Who Received Prior First Line Platinum Based Chemotherapy, ClinicalTrials.gov, Apr. 2, 2014, http://clinicaltrials.gov/ct2/show/NCT01168973?term=ramucirumab&rank=2&submit_fld_opt, pp. 1-4.
Eli Lilly and Company, A Study of Paclitaxel With or Without Ramucirumab in Metastatic Gastric Adenocarcinoma, ClinicalTrials.gov, Apr. 2, 2014, http://clinicaltrials.gov/ct2/show/NCT01170663?term=ramucirumab&rank=5&submit_fld_opt, pp. 1-4.
Eli Lilly and Company, A Study in Second Line Metastatic Colorectal Cancer, ClinicalTrials.gov, Apr. 2, 2014, http://clinicaltrials.gov/ct2/show/NCT01183780?term=ramucirumab&rank=20&submit_fld_opt., pp. 1-4.
Hoffmann-La Roche, A Study of Obinutuzumab (RO5072759) in Combination With CHOP Chemotherapy Versus MabThera/Rituxan (Rituximab) With CHOP in Patients With CD20-Positive Diffuse Large B-Cell Lymphoma (GOYA), ClinicalTrials.gov, Apr. 2, 2014, http://clinicaltrials.gov/ct2/show/NCT01287741?term=Obinutuzumab&rank=13&submit_fld_opt, pp. 1-3.
Hoffmann-La Roche, A Study of Obinutuzumab (RO5072759) Plus Chemotherapy in Comparison With MabThera/Rituxan (Rituximab) Plus Chemotherapy Followed by GA101 or MabThera/Rituxan Maintenance in Patients With Untreated Advanced Indolent Non-Hodgkin's Lymphoma (GALLIUM), ClinicalTrials.gov, Apr. 2, 2014, http://clinicaltrials.gov/ct2/show/NCT01332968, pp. 1-3.
Avid Radiopharmaceuticals, Dominantly Inherited Alzheimer Network Trial: An Opportunity to Prevent Dementia. A Study of Potential Disease Modifying Treatments in Individuals at Risk for or With a Type of Early Onset Alzheimer's Disease Caused by a Genetic Mutation. (DIAN-TU), ClinicalTrials.gov, Apr. 2, 2014, http://clinicaltrials.gov/ct2/show/NCT01760005, pp. 1-5.
Eli Lilly and Company, Progress of Mild Alzheimer's Disease in Participants on Solanezumab Versus Placebo (EXPEDITION 3), ClinicalTrials.gov, Apr. 2, 2014, http://clinicaltrials.gov/ct2/show/NCT01900665, pp. 1-3.
Eli Lilly and Company, Clinical Trial of Solanezumab for Older Individuals Who May be at Risk for Memory Loss (A4), ClinicalTrials.gov, Apr. 2, 2014, http://clinicaltrials.gov/ct2/show/NCT02008357, pp. 1-3.
Cohen, Idan et al., Differential release of chromatin-bound IL-1a Discriminates Between Necrotic and Apoptotic Cell Death by the Ability to Induce Sterile Inflammation, PNAS, 2010, vol. 107, No. 6, pp. 2574-2579.
Conde, Francisco et al. , The Aspergillus toxin restrictocin is a suitable cytotoxic agent for generation of immunoconjugates with monoclonal antibodies directed against human carcinoma cells, Eur. J. Biochem, 1989, vol. 178, No #, pp. 795-802.
Coney, Leslie et al., Cloning of Tumor-associated Antigen: MOv18 and MOv19 Antibodies Recognize a Folate-binding Protein, Cancer Research, 1991, vol. 51, No #, pp. 6125-6132.

(56) References Cited

OTHER PUBLICATIONS

Corren, Jonathan et al., Lebrikizumab Treatment in Adults with Asthma, The New England Journal of Medicine, 2011, vol. 365, No. 12, pp. 1088-1098.
Daridon, Capucine et al., Epratuzumab Affects B Cells Trafficking in Systemic Lupus Erythematosus, Ann Rheum Dis, 2011, vol. 70, No #, pp. 1-2.
Devine, Peter L. et al., The Breast Tumor-associated Epitope Defined by Monoclonal Antibody 3E1.2 is an O-linked Mucin Carbohydrate Containing N-Glycolylneuraminic Acid, Cancer Research, 1991, vol. 51, No #, pp. 5826-5836.
DiJoseph, John F. et al., Antibody-targeted chemotherapy with CMC-544: a CD22-targeted immunoconjugate of calicheamicin for the treatment of B-lymphoid malignancies, Blood, 2004, vol. 103, No #, pp. 1807-1814.
Dodart, Jean-Cosme et al., Immunization reverses memory deficits without reducing brain a burden in Alzheimer's disease model, Nature Neuroscience, 2002, vol. 5, No. 5, pp. 452-457.
Doody, Rachelle S. et al., Phase 3 Trials of Solanezumab for Mild-to-Moderate Alzheimer's Disease, NEJM Journal Watch, Apr. 2, 2014, No vol. No #, http://www.nejm.org/doi/full/10.1056/NEJMoa1312889, pp. 1-2.
National Cancer Institute, Drugs Approved for Ovarian Cancer, Aug. 16, 2013, No vol.,pp. 1-2.
Dumont, Jennifer A. et al., Prolonged activity of a recombinant factor VIII-Fc fusion protein in hemophilia A mice and dogs, Blood, 2012, vol. 119, No. #, pp. 3024-3030.
Ebel, Wolfgang et al, Preclinical Evaluation of MORAb-003, a Humanized Monoclonal Antibody Antagonizing Folate Receptor-alpha, Cancer Immunity, 2007, vol. 7 No. #, pp. 1-8.
Eisen, Tim et al., Naptumomab Estafenatox: Targeted Immunotherapy with a Novel Immunotoxin, Curr Oncol Rep, 2014, vol. 16, N. 370 pp. 2-6.
Erlandsson, Eva et al., Identification of the Antigenic Epitopes in Staphylococcal Enterotocins A and E and Design of a Superantigen for Human Cancer Therapy, J. Mol. Biol., 2003, vol. 333, No #, pp. 893-905.
Mayo Clinic, Factor Ix Complex (Intravenous Route, Injection Route) Description and Brand Name—Drugs and Supplements, http://www.mayoclinic.org/drugs-supplements/factor-ix-complex-intravenous-route-injection-route/description/drg-20063804, Apr. 1, 2014, No vol., pp. 1-3.
Ferrara, Claudia et al., Unique carbohydrate-carbohydrate interactions are required for high affinity binding between FcγRIII and antibodies lacking core fucose, PNAS, 2011, No Vo. #, pp. 1-6.
Figini, M. et al., Reversion of transformed phenotype in ovarian cancer cells by intracellular expression of anti folate receptor antibodies, Gene Therapy, 2003 vol. 10, No #, pp. 1018-1025.
Liu, Alvin et al, Production of a Mouse-Human Chimeric Monoclonal Antibody to CD20 With Potent Fc-Dependent Biological Activity, The Journal of Immunology, 1987,vol. 139, No. 10, pp. 3521-3526.
Lonial, Sagar, et al., Elotuzumab in Combination With Lenalidomide and Low-Dose Dexamethasone in Relapsed or Refractory Multiple Myeloma, Journal of Clinical Oncology, 2012, vol. 30, No. 16, pp. 1953-1959.
Lu, Dan et al., Tailoring in Vitro Selection for a Picomolar Affinity Human Antibody Directed against Vascular Endothelial Growth Factor Receptor 2 for Enhanced Neutralizing Activity, The Journal of Biological Chemistry, 2003, vol. 278, No. 44, pp. 43496-43507.
Lubberts, Erik et al., Treatment With a Neutralizing Anti-Murine Interleukin-17 Antibody After the Onset of Collagen-Induced Arthritis Reduces Joint Inflammation, Cartilage Destruction, and Cone Erosion, Arthritis & Rheumatism, 2004, vol. 50, No. 2, pp. 650-659.
MacLean, Catherine et al., Ststematic Review: Comparative Effectiveness of Treatments to Prevent Fractures in Men and Women with Low Bone Density or Osteoporosis, Annals of Internal Medicine, 2008, vol. 148, No. 3, pp. 197-217.
Marquina, Gilda et al., Gangliosides Expressed in Human Breast Cancer, Cancer Res, 1996; vol. 56, No #, pp. 5165-5171.
Matsue, Hiroyuki et al., Folate receptor allows cells to grow in low concentrations of 5-methyltetrahydrofolate, Proc. Natl. Acad. Sci. USA, Cell Biology, 1992, vol. 89, No #, pp. 6006-6009.
McInnes, Iain B et al., Efficacy and safety of secukinumab, a fully human anti-interleukin-17A monoclonal antibody, in patients with moderate-to-severe psoriatic arthritis: a 24-week, randomised, double-blind, placebo-controlled, phase II proof-of-concept trial, Ann Rheum Dis, 2014; vol. 73, No. #, pp. 349-356.
McKenney, James M. et al., Safety and Efficacy of a Monoclonal Antibody to Proprotein Convertase Subtilisin/GKexin Type 9 Serine Protease, SAR236553/REGN727, in Patients With Primary Hypercholesterolemia Receiving Ongoing Stable Atorvastatin Therapy, Journal of the American College of Cardiology, 2012, vol. 59, No. 25, pp. 2344-2353.
Di Meglio, Paola et al., The role of IL-23 in the immunopathogenesis of psoriasis, Biology Reports, 2010, vol. 2, No. 40, pp. 1-5.
Merelli, Barbara et al., Targeting the PD1/PD-L1 axis in melanoma: Biological rationale, clinical challenges and opportunities, Critical Reviews in Oncology/Hematology, 2014, vol. 89, No #, pp. 140-165.
Moreaux, Jérôme et al., BAFF and APRIL protect myeloma cells from apoptosis induced by interleukin 6 deprivation and dexamethasone, Blood, 2004, vol. 103, No #, pp. 3148-3157.
Morgan, D., Immunotherapy for Alzheimer's disease, Journal of Internal Medicine, 2011, vol. 269, No #, pp. 54-63.
Mujoo, Kalpana et al., Disialoganglioside GD2 on Human Neuroblastoma Cells: Target Antigen for Monoclonal Antibody-mediated Cytolysis and Suppression of Tumor Growth, Cancer Research, 1987, vol. 47, No #, 1098-1104.
Mujoo, Kalpana et al., Functional Properties and Effect on Growth Suppression of Human Neuroblastoma Tumors by Isotype Switch Variants of Monoclonal Antiganglioside GD2 Antibody 14.18, Cancer Research, 1989, vol. 49, No #, pp. 2857-2861.
Mössner, Ekkehard, Increasing the efficacy of CD20 antibody therapy through the and immune effector cell-mediated B-cell cytotoxicity engineering of a new type II anti-CD20 antibody with enhanced direct, Blood, 2010, vol. 115, No #, pp. 4393-4402.
Nair, P. et al., CD6 synergistic co-stimulation promoting proinflammatory response is modulated without interfering with the activated leucocyte cell adhesion molecule interaction, Clinical & Experimental Immunology, 2010, vol. 162, No #, pp. 116.130. Experimental Immunology, i_4235.
Neal, Zane C. et al., Enhanced Activity of Hu14.18-IL2 Immunocytokine against Murine NXS2 Neuroblastoma when Combined with Interleukin 2 Therapy, Clinical Cancer Research, 2004, vol. 10, pp. 4839-4847.
Neer, Robert M. et al., Effect of Parathyroid Hormone (1-34) on Fractures and Bone Mineral Density in Postmenopausal Women With Osteoporosis, The New England Journal of Medicine, 2001, vol. 344, No. 19, pp. 1434-1441.
Negrier, Claude et al., Enhanced pharmacokinetic properties of a glycoPEGylated recombinant factor IX: a first human dose trial in patients with hemophilia B, Blood, 2011, vol. 118, No #, pp. 2695-2701.
Neninger, Elia et al., Active Immunotherapy with 1E10 Anti-Idiotype Vaccine in Patients with Small Cell Lung Cancer, Cancer Biology & Therapy, 2007, vol. 6, No. 2., pp. 1-6.
Novakovic, Dijana et al., Profile of Gantenerumab and Its Potential in the Treatment of Alzheimer's Disease, Drug Design, Development and Therapy, 2013, vol. 7, No #, pp. 1359-1364.
Wright, Timothy M.D., Transforming Molecules into Breakthrough Therapies, Novartis, Investor Day, London,2013, No vol. pp. 1-16.
Oldhoff et al., Anti-IL-5 recombinant Humanized Monoclonal Antibody (Mepolizumab) for the treatment of atopic dermatitis, Allergy, 2005, vol. 60, No # pp. 693-696.
Ostrowitzki, Susanne et al., Mechanism of Amyloid Removal in Patients with Alzheimer Disease Treated with Gantenerumab, Arch Neurol., 2012, vol. 69, No. 2, pp. 1-10.

(56) References Cited

OTHER PUBLICATIONS

Ottone, F. et al., Relationship Between folate-binding Protein Expression and Cisplatin Sensitivity in Ovarian Carcinoma Cell Lines, British Journal of Cancer, 1997, vol. 76, No. 1, pp. 77-82.
Papp, KA et al., Anti-IL-17 Receptor Antibody AMG 827 Leads to Rapid Clinical Response in Subjects with Moderate to Severe Psoriasis: Results from a Phase I, Randomized, Placebo-Controlled Trial, Journal of Investigative Dermatology, 2012, vol. 132, No #, pp. 2466-2469.
Papp, Kim, et al., Brodalumab, an Anti-Interleukin-17-Receptor Antibody for Psoriasis, The New England Journal of Medicine, 2012, vol. 366, No. 13, pp. 1181-1189.
Papp, KA et al, Efficacy and safety of secukinumab in the treatment of moderate-to-severe plaque psoriasis: a randomized, double-blind, placebo-controlled phase II dose-ranging study, 2013,British Journal of Dermatology, vol. 168, No #, pp. 412-421.
Pasadhika, Sirichai et al., Update on the use of systemic biologic agents in the treatment of oninfectious uveitis, Biologics: Targets and Therapy, 2014, vol. 8 No #, pp. 67-81.
Pavord, Ian D et al., Mepolizumab for severe eosinophilic asthma (DREAM): a multicentre, double-blind, placebo-controlled trial, The Lancet, 2012, vol. 380, No Vol #, 2012, pp. 651-659.
Sanofi, Fact Sheet, PCSK9 and Alirocumab Backgrounder, Regeneron, 2013, No vol. pp. 1-3.
Peters, R.T. et al., Biochemical and functional characterization of a recombinant monomeric factor VIII-Fc fusion protein, Journal of Thrombosis and Haemostasis, 2012, vol. 11, pp. 132-141.
Powell, Jerry S. et al., Safety and prolonged activity of recombinant factor VIII Fc fusion protein in hemophilia A patients, Blood, 2012, vol. 119, No #, pp. 3031-3037.
Prewett, Marie et al., Kinase 1) Monoclonal Antibody Inhibits Tumor Angiogenesis Antivascular Endothelial Growth Factor Receptor (Fetal Liver Kinase 1) Monoclonal Antibody Inhibits Tumor Angiogenesis and Growth of Several Mouse and Human Tumors, Cancer Res, 1999; vol. 59, No #, pp. 5209-5218.
Raal, Frederick et al., Elevated PCSK9 Levels in Untreated Patients With Heterozygous or Homozygous Familial Hypercholesterolemia and the Response to High-Dose Statin Therapy, Journal of the American Heart Association, 2013, No vol., pp. 1-8.
Rich, PP. et al., Secukinumab induction and maintenance therapy in moderate-to-severe plaque psoriasis: a randomized, double-blind, placebo-controlled, phase II regimen-finding study, British Journal of Dermatology, Therapeutics, 2013, vol. 168, No #, pp. 402-411.
Rossi, Edmund et al., Trogocytosis of Multiple B-cell Surface Markers by CD22 Targeting With Epratuzumab, Blood, 2013, vol. 122, No #, pp. 3020-3029.
Rossjohn, Jamie et al., Structure of the activation domain of the GM-CSF/IL-3/IL-5 receptor common β-chain bound to an antagonist, Blood, 2000, vol. 95, No #, pp. 2491-2498.
Roth, Eli M. et al., Atorvastatin with or without an Antibody to PCSK9 in Primary Hypercholesterolemia, The New England Journal of Medicine, 2012, vol. 367, vol. 20, pp. 1891-1900.
Roufosse, Florence E., et al., Long-term safety of mepolizumab for the treatment of hypereosinophilic syndromes, J Allergy Clin Immunol. 2013; vol. 131, No. 2, pp. 461-467.
Salles, Gilles et al., Phase 1 study results of the type II glycoengineered humanized lymphoma patients anti-CD20 monoclonal antibody obinutuzumab (GA101) in B-cell, Blood, 2012, vol. 119, No #., pp. 5126-5132.
Sandborn, William J. et al., Vedolizumab as Induction and Maintenance Therapy for Crohn's Disease, The New England Journal of Medicine, 2013, vol. 369, No. 8, pp. 711-721.
Schuelke, Markus M.D. et al., Myostatin Mutation Associated With Gross Muscle Hypertrophy in a Child, The New England Journal of Medicine, 2004, vol. 350, No. 26, pp. 2862-2688.
Shusterman, Suzanne et al., Antitumor Activity of Hu14.18-IL2 in Patients With Relapsed/Refractory Neuroblastoma: A Children's Oncology Group (COG) Phase II Study, Journal of Clinical Oncology, 2010, vol. 28, No. 33, pp. 4969-4975.

Hueber, Wolfgang et al., Effects of AIN457, a Fully Human Antibody to Interleukin-17A, on Psoriasis, Rheumatoid Arthritis, and Uveitis, Science Translational Medicine, 2010, vol. 2, Issue 52, pp. 1-9.
Scursoni, Alejandra M. et al., Detection of N-Glycolyl GM3 Ganglioside in Neuroectodermal Tumors by Immunohistochemistry: An Attractive Vaccine Target for Aggressive Pediatric Cancer, Clinical and Developmental Immunology, 2011, vol. 2011, Article ID., 245181, pp. 1-6.
Semënov, Mikhail et al., SOST is a Ligand for LRP5/LRP6 and a Wnt Signaling Inhibitor, The Journal of Biological Chemistry, 2005, vol. 280, No. 29., pp. 26770-26775.
Shapiro, Amy D. et al., Recombinant factor IX-Fc fusion protein (rFIXFc) demonstrates safety and prolonged activity in a phase 1/2a study in hemophilia B patients, Blood, 2012, vol. 119, No #, pp. 666-672.
Sieger, N. et al., CD22 Ligation Inhibits Downstream B Cell Receptor Signaling and Ca2_ Flux Upon Activation, Arthritis & Rheumatism, 2013, vol. 65, No. 3, pp. 770-779.
Evel-Kabler, Kevin et al., SOCS1 Restricts Denditic Cells' Ability to Break Self Tolerance and Induce Antitumor Immunity by Regulating IL-12 Production and Signaling, The Journal of Clinical Investigation, 2006, vol. 116, No. 1, pp. 90-100.
Finn, Jonathan et al., Eradication of Neutralizing Antibodies to Factor VIII in Canine Hemophila A After liver Gene Therapy, Blood, 2010, vol. 116, No. 26, pp. 5842-5848.
Han, Shuhong et al., Novel Autoantigens in Type 1 Diabetes, Am J Transl Res, 2013, vol. 5, No. 4, pp. 379-392.
High, Katherine, et al. The Gene Therapy Journey for Hemophilia: Are We There Yet?, Blood, 2012, vol. 120, No. 23, pp. 4482-4487.
Hoffman, Brad et al., Nonredundany Roles of IL-10 and TGF-β in Supression of Immune Responses tp Hepatic AAV-Factor Factor IX Gene Transfer, The American Society of Gene and Cell Therapy, 2011, vol. 19, No. 7, pp. 1263-1272.
Hopkins, Benjamin et al., A Secreted PTEN Phosphatase That Enters Cells to Alter Signaling and Survival, Science, 2013,vol. 341, No. 399, pp. 399-341.
Takahashi, R. et al., SOCS1 is Essential for Regulatory T Cell Functions by Preventing Loss of Foxp3 Expression as Well AsIFN-y and IL-17A Production, The Journal of Experimental Medicine, 2011, vol. 208, No. 10, pp. 2055-2067.
Piganis, R. et al., Suppressor of Cyokine Signaling (SOCS) 1 Inhibits Type 1 Interferon (IFN) Signaling via the Interferon a Receptor (IFNAR1)-associated Tyrosine Kinase Tyk2, The Journal of Biological Chemistry, vol. 286, No. 39, pp. 33811-33818.
Jacobsen, Lars et al., Allergen-specific Immunotherapy Provide Immediate, Long-Term and Preventive Clinical Effects in Children and Adults: The Effects of Immunotherapy Can be Categorised by Level of Benefit—the centenary of Allergen Specific Subcutaneous Immunotherapy, Clinical and Translational Allergen, 2012, vol. 2, No. 8, pp. 1-11.
Kinjyo, Ichiko et al., SOCS1/JAB is a Negative Regulator of LPD-Induced Macrophage Activation, Immunity, 2002, vol. 17, No number, pp. 583-591.
LoDuca, Paul et al., Hepatic Gene Transfer as a Means of Tolerance Induction to Transgene Products, Curr Gene Ther. 2009, vol. 9, No. 2, pp. 104-114.
Lu, Li-Fan et al., Foxp3-Dependent MicroRNA 155 Confers Competitive Fitness to Regulatory T Cells by Targeting SOCS1 Protein, CellPress, Immunity, 2008, No Volume Number, pp. 80-91.
Luo, Xunrong et al., Dendritic Cells with TGF-B1 Differentiate naïve CD4=CD25-T Cells Into Islet-Protective Foxp3+ Regulatory T Cells, PNAS, 2007, vol. 104, No. 8, pp. 2821-2826.
Mingozzi, Federico, et al., Pharmacological Modulation of Humoral Immunity in a Nonhuman Primate Model AAV Gene Transfer for Hemophilia B, The American Society of Gene & Cell Therapy, 2012, vol. 20, No. 7, pp. 1410-1416.
Peakman, Mark et al., Can We Vaccinate Against Type 1 Diabetes, F1000Reports Biology, 2012, No Volume no., pp. 1-8.
Roep, Bart et al., Antigen Targets of Type 1 Diabetes Autoimmunity, Cold Spring Harbor Perspectives in Medicine, 2013, No vol., pp. 1-15.

(56) References Cited

OTHER PUBLICATIONS

Suciu-Foca, Nicole et al., Soluble IG-Like Transcript 3 Inhibits Tumor Allograft Rejection in Humanized SCID Mice and T Cell Responses in Cancer Patients, The Journal of Immunology, 2007, vol. 178, pp. 4732-7441.
Vlad, George et al., Immunoglobulin-Like Transcript 3-FC Suppresses T-Cell Responses to Allogeneic Human Islet Transplants in hu-NOD/SCID Mice, Diabetes, 2006, vol. 57, No number , pp. 1-9.
Wantabee, Hisayo et al., Experimental Autoimmune Thyroiditis Induced b Thyroglobulin-Pulsed Dendritic Cells, 1999, vol. 31, No. 4, pp. 273-282.
Wing, Kajsa et al., Regulatory T Cells Exert Checks and Balances on Self Tolerance and Autoimmunity, Nature Immunology, 2010, vol. 11, No. 1, pp. 1-8.
Yang, Junbao et al., CD+Tcells from Type 1 Diabetic and Healthy Subjects Exhibit Different Thresholds of Activation to a Naturally Processed Proinsulin Epitope, Journal of Autoimmunity, 2008, vol. 31, No vol. number, pp. 30-41.
Taniguchi, Takashi et al., Serum Levels of Galectin-3: Possible Association with Fibrosis, Aberrant Angiogenesis, and Immune Activation in Patients with Systemic Sclerosis, The Journal of Rheumatology, 2012, vol. 39, No. 3, pp. 539-544.
Chen, Juine-Ruey, et al., Vaccination of Monoglycosylated Hemagglutinin Induces Cross-Strain Protection Against Influenza Virus Infection, PNAS, 2013, No Volume Number, pp. 1-6.
Apostolopoulos, Vasso et al. , Targeting Antigens to Dendritic Cell Receptors for Vaccine Development, Hindawi Publishing Corporation Journal of Drug Delivery, 2013, vol. 201, Article ID 869718, pp. 1-22.
Deering, Raquel et al., Nucleic Acid Vaccines: Prospects for Non-Viral Delivery of mRNA Vaccines, Expert Opinion, 2014, vol. 11, No. 6, pp. 1-15.
Falugi, Fabiana et al., Role of Protien a in the Evasion of Host Adaptive Immune Responses by *Staphylococcus aureus,* mBio, 2014, vol. 4, Issue 5, pp. 1-10.
Geijtenbeek, Teunis et al., Identification of DC-SIGN, A Novel Dendritic Cell-Specific ICAM-3 Receptor That Supports Primary Immune Responses, Cell, 2000, vol. 100, pp. 575-585.
World Health Organization, Department of Communicable Disease Surveillance and Response, WHO/CSR, 2000, Chapter 7, pp. 1-7.
Gupta, Shivali et al., TcVac3 Induced Control of Trypanosoma Cruzi Infection and Chronic Myocarditis in Mice, PLOS One, 2013, vol. 8, Issue 3, pp. 1-16.
Nogueira, Raquel et al., Recombinant Yellow Fever Viruses Elicit CD8+ T Cell Responses and Protective Immunity Against Trypanosoma Cruzi, PLOS One, 2013, vol. 8, Issue 3, pp. 1-13.
Barr, Ian et al., Epidemiological, Antigen and Genetic Characteristics of Seasonal Influenza a(H1N1), A (H3N2) and B Influenza Virus: Basis for WHO Recommendation on the Competition of Influenza Vaccines for Using in the 2009-2010 Northern Hemisphere Season, Vaccine, 2010, vol. 28, No number, pp. 1156-1167.
Kim, Hwan Keun et al., Nontoxigenic Protein A Vaccine for Methicillin-Resistant *Staphylococcus aureus* Infections in Mice, The Journal of Experimental Medicine, 2010, vol. 207, No. 9, pp. 1863-1870.
Lee, Justin B. et al., Lipid Nanoparticle siRNA Systems for Silencing the Androgen Receptor in Human Prostate Cancer in Vivo, International Journal of Cancer, 2012, vol. 131, pp. 781-790.
Brandenburg, Boerries et al., Mechanisms of Hemagglutinin Targeted Influenza Virus Neutralization, PLOS One, 2013, vol. 8, Issue 12, pp. 1-14.
Messer, William B. et al., Dengue Virus Envelope Protein Domain I/II Hinge Determines long-livid Serotype-Specific Dengue Immunity, PNAS, 2014, vol. 111, No. 5, 1939-1944.
Metz, Bernard et al, Identification of Formaldehyde-induced Modifications in Proteins, The Journal of Biological Chemistry, 2004,vol. 279, No. 8, pp. 6235-6243.
Mohamadzadeh, M et al., Dendritic Cell Targeting of Bacillus Anthracis Protective Antigen Expressed by Lactobacillus Acidophilus Protects Mice From Lethal Challenge, PNAS, 2009, vol. 106, No. 11, pp. 4331-4336.
Perez-Velez, Mariel et al., Induction of Neutralization Antibodies in Mice by Dengue-2 Envelope DNA Vaccines, National Institutes of Health, PR Health Sci, 2009, vol. 28, No. 3, pp. 239-250.
Ramanathan, Mathura et al., Development of Novel DNA SynCon Tetravalent Dengue Vaccine That Elicits Immune Responses Against Four Serotypes, Vaccine, 2009, vol. 27, No Number, pp. 6444-6453.
Schroeder, Ulrich et al. , Peptide Nanoparticles Serve as a Powerful Platform for the Immunogenic Display of Poorly Antigenic Actin Determinants, Science Direct, J. Mol. Biol., 2009, vol. 386, No vol. Number, pp. 1368-1381.
Arce-Fonseca, Minerva et al., Specific Humoral and Cellular Immunity Induced by Trypanosoma cruzi DNA Immunization in a Canine Model, Veterinary Research, 2013, vol. 44, No. 15, pp. 2-9.
Steel, John et l., Influenza Virus Vaccine Based on the Conserved Hemagglutinin Stalk Domain, mBio, 2010, vol. 1, Issue 1, pp. 1-10.
Walker, Andreas et al., SplitCore: An Exceptionally Versatile Viral NanoParticles for Native Whole Protein Display Regardless of 3D Structure, Scientific Reporters, 2011, vol. 1, No. 5, pp. 1-8.
World Health Organization, WHO Manual on Animal Influenza Diagnosis and Surveillance, WHO Global Influenza Programme, CDS, CSR, NCS, 2002, vol. 5, No Number, pp. 1-99.
World Health Organization, Serological Diagnosis of Influenza by Microneutralization Assay, 2010, No vol., pp. 1-25.
Coller, Barry S. et al, A New Murine Monoclonal Antibody Reports an Activation-Dependent Change in the Confirmation and/or Microenvironment of the Platelet Glycoprotein IIb/IIIa Complex, The American Society for Clinical Investigation, Inc., 1985, vol. 76, No Volume number, pp. 101-108.
Coller, BS et al., Inhibition of Dog Platelet Function by Vivo Infusion of F (ab')2 Fragments of a Monoclonal Antibody to Platelet Glycoprotien IIb/IIIa Receptor, Blood, 1985, vol. 66, No. 6, pp. 1456-1459.
Ellis, SG et al., Safety and Antiplatelet Effect of Murine Monoclonal Antibody 7E3 Fab Directed Against Platelet Glycoprotein IIb/IIA in Patients Undergoing Elective Coronary Angioplasty, Coron Artery Dis., 1993, vol. 4, No. 2, pp. 167-175.
Abciximab (ReoPro)FDA Description, Jan. 4, 1997, No Volume number, pp. 1-17.
Califf, Robert et al., Use of a Monoclonal Antibody Directed Against the Platelet Glycoprotein IIB/IIIa Receptor in High-Risk Coronary Angioplasty, 1994, The New England Journal of Medicine, vol. 330, No. 14, pp. 1-6.
Vasquez, Ana et al., Racotumomab: an anti-idiotype vaccine related to N-Glycolyl-containing gangliosides-preclinical and clinical date, Frontiers in Oncology, 2012, vol. 2, Article 150, pp. 1-6.
Forsberg, G. et al., Therapy of Human Non-Small-Cell Lung Carcinoma Using Antibody Targeting of a Modified Superantigen, British Journal of Cancer, 2001, vol. 85, No. 1, pp. 129-136.
Forsberg, G et al., Naptumomab Estafentoz, an Engineered Antibody-superantigen Fusion Protien with Low Toxicity and Reduced Antigenicity, J Immunother, 2010, vol. 33, No. 5, pp. 492-499.
Feagan, Brian et al., Vedolizumab as Induction and Maintenance Therapy for Ulcerative Colitis, The New England Journal of Medicine, 2013, vol. 369, No. 8, pp. 699-710.
Furie, Richard et al., A Phase III, Randomized, Placebo-Controlled Study of Belimumab, a Monoclonal Antibody That Inhibits B Lymphocyte Stimulator, in Patients With Systemic Lupus Erythematosus, Arthritis & Rheumatism, 2011, vol. 63, No. 12, pp. 3918-3930.
Garcia, Gilles et al., Anti-interleukin-5 Therapy in Serve Asthma, Rare Diseases and Orphan Drugs, 2013, vol. 22, No. #, pp. 251-257.
Garin-Chesa, Pilar et al., Trophoblast and Ovarian Cancer Antigen LK26, American Journal of Pathology, 1993, vol. 142, No. 2, pp. 557-567.
Genovese, Mark C et al., Efficacy and safety of secukinumab in patients with rheumatoid arthritis: a phase II, dose-finding, double-blind, randomised, placebo controlled study, Ann Rheum Dis, 2013; vol. 72, No #, pp. 863-869.

(56) References Cited

OTHER PUBLICATIONS

Genovese, Mark C et al., A phase 2 dose-ranging study of subcutaneous tabalumab for the treatment of patients with active rheumatoid arthritis and an inadequate response to methotrexate, Ann Rheum Dis 2013; vol. 72, No#, pp. 1453-1460.

Genovese, Mark C et al., Ocrelizumab, a Humanized Anti-CD20 Monoclonal Antibody, in the Treatment of Patients With Rheumatoid Arthritis, Arthritis & Rheumatism, 2008, vol. 58, No. 9, pp. 2652-2661.

Gevaert, Philippe, et al., Mepolizumab, a humanized anti-IL-5 mAb, as a treatment option for severe nasal polyposis, Rhinitis, sinusitis, and upper airway disease, J Allergy Clin Immunol, 2011, vol. 128, No. 5, pp. 989-995.

Ghazi, Aasia et al., Benralizumab—a humanized mAb to IL-5Rα with enhanced antibody-dependent cell-mediated cytotoxicity—a novel approach for the treatment of asthma, Expert Opin Biol Ther. 2012, vol. 12, No. 1, pp. 113-118.

Gillies, Stephen et al., Antibody-targeted interleukin 2 stimulates T-cell killing of Autologous Tumor Cells, Proc. Natl. Acad. Sci., 1992, vol. 89, No #, pp. 1428-1432.

Grant, Ryan W. et al., Mechanisms of disease: inflammasome activation and the development of type 2 diabetes, Frontiers in Immunology, 2013, vol. 4, Article 50, pp. 1-10.

Greenfeder, Scott et al., Th2 cytokines and asthma the role of interleukin-5 in allergic eosinophilic disease, Respiratory Research, 2001, vol. 2, No. 2, pp. 71-79.

Grünig, Gabriele et al., Interleukin 13 and the evolution of asthma therapy, Am J Clin Exp Immunol, 2012;vol. 1, No. 1, pp. 20-27.

Hamid, Omid et al., Safety and Tumor Responses with Lambrolizumab (Anti-PD-1) in Melanoma, The New England Journal of Medicine, 2013, vol. 369, No. 2, pp. 134-144.

Hank, Jacquelyn, et al., Immunogenicity of the Hu14.18-IL2 Immunocytokine Molecule in Adults With Melanoma and Children With Neuroblastoma, Clinical Cancer Research, 2009, vol. 15, No. 18, pp. 5923-5930.

Hart, Timothy K. et al., Preclinical efficacy and safety of mepolizumab (SB-240563), a humanized monoclonal antibody to IL-5, in cynomolgus monkeys, J Allergy Clin Immunol, 2001, vol. 108, No. 2, pp. 250-257.

Hedlund, Gunnar et al., The Tumor Targeted Superantigen ABR-217620 Selectively Engages TRBV7-9 and Exploits TCR-pMHC Affinity Mimicry in Mediating T Cell Cytotoxicity, PLOS One, 2013, vol. 8, Issue 10, pp. 1-17.

Hernández, Ana Maria et al., Anti-NeuGcGM3 Antibodies, Actively Elicited by Idiotypic Vaccination in Nonsmall Cell Lung Cancer Patients, Induce Tumor Cell Death by an Oncosis-Like Mechanism, The Journal of Immunology, 2011, vol. 186, No #, pp. 3735-3744.

Humbert, Marc et al., Relationship between IL-4 and IL-5 mRNA Expression and Disease Severity in Atopic Asthma, Am J Respir Crit Care Med, 1997, vol. 156, No #, pp. 704-708.

Hole, N. et al., A 72 kD trophoblast glycoprotein defined by a monoclonal antibody, Br. J. Cancer 1988,vol. 57, No. #, pp. 239-246.

Huizinga, Tom W J et al., Sarilumab, a fully human monoclonal antibody against IL-6Rα in patients with rheumatoid arthritis and an inadequate response to methotrexate: efficacy and safety results from the randomized SARIL-RA-Mobility Part A trial, Ann Rheum Dis, 2013; No Vol. pp. 1-9.

Imbimbo, Bruno P et al., Solanezumab for the treatment of mild-to-moderate Alzheimer's disease, Expert Rev. Clin. Immunol., 2012, vol. 8, No. 2, pp. 135-149.

Ito, Asahi et al., Defucosylated anti-CCR4 monoclonal antibody exercises potent ADCC-mediated antitumor eVect in the novel tumor-bearing humanized NOD/Shi-scid, IL-2R_null mouse model, Cancer Immunol Immunother, 2009, vol. 58, No #, pp. 1195-1206.

Winkler, David G. et al., Noggin and Sclerostin Bone Morphogenetic Protein Antagonists Form a Mutually Inhibitory Complex, J. Biol. Chem., 2004, vol. 279, pp. 36293-36298.

Janssens, Ann et al., Rixuximab for Chronic Lymphocytic Leukemia in Treatment-Naïve and Treatment-Experienced, OneLive, Bringing Oncology Together, Apr. 2, 2014, No vol. , pp. 1-7.

Jia, Guiquan et al., Periostin is a systemic biomarker of eosinophilic airway inflammation in asthmatic patients, J Allergy Clin Immunol, 2012, vol. 130, No. 3, pp. 647-654.

Jin, Wei et al., IL-17 cytokines in immunity and inflammation, Emerging Microbes and Infections, 2013, vol. 2, No. #, pp. 1-5.

Kappos, Ludwig, et al., Ocrelizumab in relapsing-remitting multiple sclerosis: a phase 2, randomised, placebo-controlled, multicentre trial, The Lancet, 2011, vol. 378, Issue 9805, pp. 1779-1787.

Kaur, Sukhwinder et al., Mucins in pancreatic cancer and its microenvironment, Nature Reviews, 2013, No vol., pp. 1-14.

Kausar, Fariha et al., Ocrelizumab: A Step Forward in the Evolution of B-Cell Therapy, Expert Opinion Biol. Ther., 2009, vol. 9, No. 7, pp. 889-895.

Kim, Busun et al., The Interleukin-1α precursor is Biologically Active and Is Likely a Key Alarmin in the IL-1 Family of Cytokines, Frontiers in Immunology, 2013, vol. 4, Article 391, pp. 1-9.

Kips, Johan et al., Effect of SCH55700, a Humanized Anti-Human Interleukin-5 Antibody, in Severe Persistent Asthma, American Journal of Respiratory and Critical Care Medicine, Safety of Anti-IL-5 in Asthma, vol. 167, pp. 1655-1659.

Koenigsknecht-Talboo, Jessica et al., Rapid Microglial Response Around Amyloid Pathology after Systemic Anti-A_Antibody Administration in PDAPP Mice, The Journal of Neuroscience, 2008, vol. 28, No. 52, pp. 14156-1414.

Kolbeck, Roland et al., MEDI-563, a humanized anti-IL-5 receptor a mAb with enhanced antibody-dependent cell-mediated cytotoxicity function, J Allergy Clin Immunol, vol. 125, No. 6, pp. 1344-1353.

Koren, Michel J. et al., Efficacy and Safety of Longer-Term Administration of Evolocumab (AMG 145) in Patients With Hypercholesterolemia: 52-Week Results From the Open-Label Study of Long-Term Evaluation Against LDL-C (OSLER) Randomized Trial, Circulation, 2013, No vol., pp. 1-20.

Kreitman, Robert J. et al., Antibody Fusion Proteins: Anti-CD22 Recombinant Immunotoxin Moxetumomab Pasudotox, Clinical Cancer Research, 2011, vol. 17, No #, pp. 6398-6405.

Kreitman, Robert J. et al., Phase I Trial of Anti-CD22 Recombinant Immunotoxin Moxetumomab Pasudotox (CAT-8015 or HA22) in Patients With Hairy Cell Leukemia, Journal of Clinical Oncology, 2012, vol. 30, No. 15, pp. 1822-1826.

Krueger, Gerald G. et al., A Human Interleukin-12/23 Monoclonal Antibody for the Treatment of Psoriasis, The New England Journal of Medicine, 2007,vol. 356, No. 6, pp. 580-592.

Kuenen, Bart et al., A Phase I Pharmacologic Study of Necitumumab (IMC-11F8), a Fully Human IgG 1 Monoclonal Antibody Directed Against EGFR in Patients with Advanced Solid Malignancies, Clinical Cancer Research, 2010, vol. 16, No #, pp. 1915-1923.

Kuijpers, Taco W. et al., CD20 deficiency in humans results in impaired T cell-independent antibody responses, The Journal of Clinical Investigation, 2010, vol. 120, No. 1, pp. 214-222.

Kurzrock, Razelle et al., A Phase I, Open-Label Study of Siltuximab, an Anti-IL-6 Monoclonal Antibody, in Patients with B-cell Non-Hodgkin Lymphoma, Multiple Myeloma, or Castleman Disease,Clinical Cancer Research, 2013, vol. 19, No #, pp. 3659-3670.

Lach-Trifilieff, Estelle et al., An Antibody Blocking Activin Type II Hypertrophy and Protects from Atrophy Receptors Induces Strong Skeletal Muscle, Molecular and Cellular Biology, 2004, vol. 34, No. 4, pp. 606-618.

Legleiter, Justin et al., Effect of Different Anti-Aβ Antibodies on Aβ Fibrillogenesis as AAssessed by Atomic Force Microscopy, J. Mol. Biol, 2004, vol. 335, No #, pp. 997-1006.

Leonard, JP et al., Preclinical and clinical evaluation of epratuzumab (anti-CD22 IgG) in B-cell malignancies, Oncogene, 2007, vol. 26 No #, pp. 3704-3713.

Leonardi, Craig et al., Anti-Interleukin-17 Monoclonal Antibody Ixekizumab in Chronic Plaque Psoriasis, The New England Journal of Medicine, 2012, vol. 366, No. 13, pp. 1190-1199.

(56) References Cited

OTHER PUBLICATIONS

Lindén, Ola, et al., Dose-Fractionated Radioimmunotherapy in Non-Hodgkin's Lymphoma Using DOTA-Conjugated, 90Y-Radiolabeled, Humanized Anti-CD22 Monoclonal Antibody, Epratuzumab, Clinical Cancer Research, 2005, vol. 11, No #, pp. 5215-5222.
Braun, Stephen et al., Preclinical Studies of Lymphocyte Gene Therapy for Mild Hunter Syndrome (Mucopolysaccharidosis Type II), Human Gene Therapy, 1996, vol. 7, pp. 283-290.
PCT Invitation to pay additional fees and, where applicable, protest fee for International application No. PCT/US2013/030061, dated Aug. 22, 2013.
Tripathy, Sandeep et al., Long-term expression of erythopoietin in the systemic circulation of mice after intramuscular injection of a plasmid DNA vector, Proc. Natl. Acad. Sci. USA 93, 1996, pp. 10876-10880.
Yarovoi, Helen et al., Factor VIII ectopically expressed in platelets: efficacy in hemophilia A treatment, Blood Journal, Dec. 1, 2003, vol. 102 No. 12, pp. 4005-4013.
PCT Invitation to pay additional fees and, where applicable, protest fee for International application No. PCT/US2013/030062, dated Jul. 19, 2013.
PCT Invitation to pay additional fees and, where applicable, protest fee for International application No. PCT/US2013/030064, dated Jul. 5, 2013.
Parker et al., Targeting of Polyelectrolyte RNA Complexes to Cell Surface Integrins as an Efficient, Cytoplasmic Transfection Mechanism, Journal of Bioactive and Compatible Polymers, Jul. 2002, pp. 1-10.
Kenneth Stanley, Design of Randomized Controlled Trials, Circulation, 2007; 115: pp. 1164-1169.
Chen XL, et al., Expression of human factor IX in retrovirus-transfected human umbilical cord tissue derived mesenchymal stem cells, PubMed, Feb. 2009; 17 (1): 184-87.
Cowling (Jan. 15, 2010, online Dec. 23, 2009, "Regulation of mRNA cap methylation," Biochemical Journal, 425 (Pt 2): 295-302.
Kozak, Marilyn, Regulation of translation via mRNA structure in prokaryotes and eukaryotes, Gene 361 (2005), pp. 13-37.
Fuke, Hiroyuki et al., Role of poly (A) tail as an identity element for mRna nuclear export, Nucleic Acids Research, 2008, vol. 36 No. 3, pp. 1037-1049.
Roger S. Riley, MD, Ph.D., Apr. 2005, http://www.pathology.vcu.edu/clinical/coag/FIX%20Deficiency.pdf, no volume, no pages, no publisher, no journal, 2 pages long.
SEQ Search Result 1(U.S. Appl. No. 13/897,362) dated Oct. 11, 2013.
Tracy, M. "Progress in the Development of LNP Delivery for siRNA Advancing LNPs to the Clinic," International Liposome Research Days Meeting, Vancouver, Canada. Aug. 2010, pp. 1-52.
International Search Report from International Application No. PCT/US2013/030064 dated Oct. 21, 2013.
International Search Report from International Application No. PCT/US2013/030062 dated Oct. 21, 2013.
International Preliminary Report on Patentability in International Application No. PCT/US2013/062943, dated Jun. 4, 2015.
Ørom, Ulf Andersson et al., MicroRNA-10a Binds the 5OUTR of Ribosomal Protein mRNAs and Enhances Their Translation, Cell Press, Molecular Cell 30, May 23, 2008, vol. 30, pp. 460-471.
Wellensiek, Brian P. et al., Genome-Wide Profiling of Cap-Independent Translation Enhancing Elements in the Human Genome, Nat Methods, vol. 10, No. 8, Aug. 2013 : pp. 747-750.
Brown, Brian et al, Endogenous microRNA can be broadly exploited to regulate trasgene expression according to tissue, lineage and differentiation state, Nature Biotechnology, Nature Publishing Group, vol. 25, No. 12, Nov. 16, 2007, pp. 1457-1467.
Savino, M et al., The Action Mechanism of the Myc Inhibitor Termed Omomyc May Give Clues on How to Target Myc for Cancer Therapy, PLOS One, vol. 6., No. 7, Jul. 21, 2011, pp. e22284-e22284.
Annoni, A. et al., "In vivo delivery of a microRNA-regulated transgene induces antigen-specific regulatory T cells and promotes immunologic tolerance," Blood, vol. 114, pp. 5152-5161 (2009).
Kron, M. et al., "mlRNA-mediated silencing in hepatocytes can increase adaptive immune responses to adenovirus vector-delivered transgenic antigens," Molecular Therapy, vol. 19(8) pp. 1547-1557 (2011).
Wolff, L. et al., "Effect of tissue-specific promoters and microRNA recognition elements on stability of transgene expression after hydrodynamic naked plasmid DNA delivery," Human Gene Therapy, vol. 20, pp. 374-388 (2009).
U.S. Appl. No. 14/041,011, filed Sep. 30, 2013, Stephen G. Hoge.
U.S. Appl. No. 14/135,876, filed Dec. 20, 2013, Stephen G. Hoge.
U.S. Appl. No. 14/041,011, Reply to Restriction Requirement, Oct. 21, 2015.
U.S. Appl. No. 14/041,011, Restriction Requirement, Apr. 22, 2015.
U.S. Appl. No. 14/135,876, Notice of Abandonment, Apr. 23, 2015.
U.S. Appl. No. 14/135,876, Advisory Action, Dec. 19, 2014.
U.S. Appl. No. 14/135,876, Examiner-Initiated Interview Summary, Dec. 19, 2014.
U.S. Appl. No. 14/135,876, Response to Final Office Action, Oct. 29, 2014.
U.S. Appl. No. 14/135,876, Final Office Action, Jul. 31, 2014.
U.S. Appl. No. 14/135,876, Response to Non-Final Office Action, Jun. 5, 2014.
U.S. Appl. No. 14/135,876, Non-Final Office Action, Mar. 6, 2014.
Singh, R. et al., "Nanoengineering artificial lipid envelopes around adenovirus by self-assembly," ACS Nano, vol. 2 (5):1040-1050 (2008).
Suzuki, T. et al., "miR-122a-Regulated Expression of a Suicide Gene Prevents Hepatotoxicity Without Altering Antitumor Effects in Suicide Gene Therapy," Molecular Therapy, vol. 16(10): 1719-1726 (2008).

* cited by examiner

PRIOR ART

TERMINALLY MODIFIED RNA

CROSS REFERENCE TO RELATED APPLICATIONS

This application claims priority to U.S. Provisional Patent Application No. 61/729,933, filed Nov. 26, 2012, entitled Terminally Optimized Modified RNAs, U.S. Provisional Patent Application No. 61/737,224, filed Dec. 14, 2012, entitled Terminally Optimized Modified RNAs, U.S. Provisional Patent Application No. 61/758,921, filed Jan. 31, 2013, entitled Differential Targeting Using RNA Constructs, U.S. Provisional Patent Application No. 61/781,139, filed Mar. 14, 2013, entitled Differential Targeting Using RNA Constructs, U.S. Provisional Patent Application No. 61/829,359, filed May 31, 2013, entitled Differential Targeting Using RNA Constructs, U.S. Provisional Patent Application No. 61/839,903, filed Jun. 27, 2013, entitled Differential Targeting Using RNA Constructs, U.S. Provisional Patent Application No. 61/842,709, filed Jul. 3, 2013, entitled Differential Targeting Using RNA Constructs, U.S. Provisional Patent Application No. 61/857,436, filed Jul. 23, 2013, entitled Differential Targeting Using RNA Constructs, U.S. Provisional Patent Application No. 61/775,509, filed Mar. 9, 2013, entitled Heterologous Untranslated Regions for mRNA and U.S. Provisional Patent Application No. 61/829,372, filed May 31, 2013, entitled Heterologous Untranslated Regions for mRNA; the contents of each of which are herein incorporated by reference in their entireties.

REFERENCE TO SEQUENCE LISTING

The present application is being filed along with a Sequence Listing in electronic format. The Sequence Listing is provided as a file entitled M39US2.txt created on Oct. 1, 2013 which is 3,263,045 bytes in size. The information in electronic format of the sequence listing is incorporated herein by reference in its entirety.

FIELD OF THE INVENTION

The invention relates to compositions and methods for the manufacture and use of modified and/or optimized mRNA and their use in combination with one or more modified or wild type mRNA encoding an RNA binding protein.

BACKGROUND OF THE INVENTION

Naturally occurring RNAs are synthesized from four basic ribonucleotides: ATP, CTP, UTP and GTP, but may contain post-transcriptionally modified nucleotides. Further, approximately one hundred different nucleoside modifications have been identified in RNA (Rozenski, J, Crain, P, and McCloskey, J. (1999). The RNA Modification Database: 1999 update. Nucl Acids Res 27: 196-197, herein incorporated by reference in its entirety).

There are multiple problems with prior methodologies of effecting protein expression. For example, heterologous deoxyribonucleic acid (DNA) introduced into a cell can be inherited by daughter cells (whether or not the heterologous DNA has integrated into the chromosome) or by offspring. Introduced DNA can integrate into host cell genomic DNA at some frequency, resulting in alterations and/or damage to the host cell genomic DNA. In addition, multiple steps must occur before a protein is made. Once inside the cell, DNA must be transported into the nucleus where it is transcribed into RNA. The RNA transcribed from DNA must then enter the cytoplasm where it is translated into protein. This need for multiple processing steps creates lag times before the generation of a protein of interest. Further, it is difficult to obtain DNA expression in cells; frequently DNA enters cells but is not expressed or not expressed at reasonable rates or concentrations. This can be a particular problem when DNA is introduced into cells such as primary cells or modified cell lines. The role of nucleoside modifications on the immunostimulatory potential, stability, and on the translation efficiency of RNA, and the consequent benefits to this for enhancing protein expression and producing therapeutics have been previously explored. Such studies are detailed in published co-pending International Publication No WO2012019168 filed Aug. 5, 2011, International Publication No WO2012045082 filed Oct. 3, 2011, International Publication No WO2012045075 filed Oct. 3, 2011, International Publication No WO2013052523 filed Oct. 3, 2012, and International Publication No WO2013090648 filed Dec. 14, 2012 the contents of which are incorporated herein by reference in their entirety.

The use of modified polynucleotides in the fields of antibodies, viruses, veterinary applications and a variety of in vivo settings have been explored and are disclosed in, for example, co-pending and co-owned U.S. Provisional Patent Application No. 61/618,862, filed Apr. 2, 2012, entitled Modified Polynucleotides for the Production of Biologics; U.S. Provisional Patent Application No. 61/681,645, filed Aug. 10, 2012, entitled Modified Polynucleotides for the Production of Biologics; U.S. Provisional Patent Application No. 61/737,130, filed Dec. 14, 2012, entitled Modified Polynucleotides for the Production of Biologics; U.S. Provisional Patent Application No. 61/618,866, filed Apr. 2, 2012, entitled Modified Polynucleotides for the Production of Antibodies; U.S. Provisional Patent Application No. 61/681,647, filed Aug. 10, 2012, entitled Modified Polynucleotides for the Production of Antibodies; U.S. Provisional Patent Application No. 61/737,134, filed Dec. 14, 2012, entitled Modified Polynucleotides for the Production of Antibodies; U.S. Provisional Patent Application No. 61/618,868, filed Apr. 2, 2012, entitled Modified Polynucleotides for the Production of Vaccines; U.S. Provisional Patent Application No. 61/681,648, filed Aug. 10, 2012, entitled Modified Polynucleotides for the Production of Vaccines; U.S. Provisional Patent Application No. 61/737,135, filed Dec. 14, 2012, entitled Modified Polynucleotides for the Production of Vaccines; U.S. Provisional Patent Application No. 61/618,870, filed Apr. 2, 2012, entitled Modified Polynucleotides for the Production of Therapeutic Proteins and Peptides; U.S. Provisional Patent Application No. 61/681,649, filed Aug. 10, 2012, entitled Modified Polynucleotides for the Production of Therapeutic Proteins and Peptides; U.S. Provisional Patent Application No. 61/737,139, filed Dec. 14, 2012, Modified Polynucleotides for the Production of Therapeutic Proteins and Peptides; U.S. Provisional Patent Application No. 61/618,873, filed Apr. 2, 2012, entitled Modified Polynucleotides for the Production of Secreted Proteins; U.S. Provisional Patent Application No. 61/681,650, filed Aug. 10, 2012, entitled Modified Polynucleotides for the Production of Secreted Proteins; U.S. Provisional Patent Application No. 61/737,147, filed Dec. 14, 2012, entitled Modified Polynucleotides for the Production of Secreted Proteins; U.S. Provisional Patent Application No. 61/618,878, filed Apr. 2, 2012, entitled Modified Polynucleotides for the Production of Plasma Membrane Proteins; U.S. Provisional Patent Application No. 61/681,654, filed Aug. 10, 2012, entitled Modified Polynucleotides for the Production of Plasma Membrane Proteins; U.S. Provisional Patent Application No. 61/737,152, filed Dec. 14, 2012, entitled Modified Polynucleotides for the Production of Plasma Membrane Proteins; U.S. Provisional Patent Application No. 61/618,885, filed Apr. 2, 2012, entitled Modified Polynucleotides for the Production of Cytoplasmic and Cytoskeletal Proteins; U.S. Provisional Patent Application No. 61/681,658, filed Aug. 10, 2012, entitled Modified Polynucleotides for the Production of Cytoplasmic and Cytoskeletal Proteins; U.S. Provisional Patent Application No. 61/737,155, filed Dec. 14, 2012, entitled Modified Polynucleotides for the Production of Cytoplasmic and Cytoskeletal Proteins; U.S. Provisional Patent Application No. 61/618,896, filed Apr. 2, 2012, entitled Modified Polynucleotides for the Production of Intracellular Membrane Bound Proteins; U.S. Provisional Patent Application No. 61/668,157, filed Jul. 5, 2012, entitled Modified Polynucleotides for the Production of Intracellular Membrane Bound Proteins; U.S. Provisional Patent Application No. 61/681,661, filed Aug. 10, 2012, entitled Modified Polynucleotides for the Production of Intracellular Membrane Bound Proteins; U.S. Provisional Patent Application No. 61/737,160, filed Dec. 14, 2012, entitled Modified Polynucleotides for the Production of Intracellular Membrane Bound Proteins; U.S. Provisional Patent Application No. 61/618,911, filed Apr. 2, 2012, entitled Modified Polynucleotides for the Production of Nuclear Proteins; U.S. Provisional Patent Application No. 61/681,667, filed Aug. 10, 2012, entitled Modified Polynucleotides for the Production of Nuclear Proteins; U.S. Provisional Patent Application No. 61/737,168, filed Dec. 14, 2012, entitled Modified Polynucleotides for the Production of Nuclear Proteins; U.S. Provisional Patent Application No. 61/618,922, filed Apr. 2, 2012, entitled Modified Polynucleotides for the Production of Proteins; U.S. Provisional Patent Application No. 61/681,675, filed Aug. 10, 2012, entitled Modified Polynucleotides for the Production of Proteins; U.S. Provisional Patent Application No. 61/737,174, filed Dec. 14, 2012, entitled Modified Polynucleotides for the Production of Proteins; U.S. Provisional Patent Application No. 61/618,935, filed Apr. 2, 2012, entitled Modified Polynucleotides for the Production of Proteins Associated with Human Disease; U.S. Provisional Patent Application No. 61/681,687, filed Aug. 10, 2012, entitled Modified Polynucleotides for the Production of Proteins Associated with Human Disease; U.S. Provisional Patent Application No. 61/737,184, filed Dec. 14, 2012, entitled Modified Polynucleotides for the Production of Proteins Associated with Human Disease; U.S. Provisional Patent Application No. 61/618,945, filed Apr. 2, 2012, entitled Modified Polynucleotides for the Production of Proteins Associated with Human Disease; U.S. Provisional Patent Application No. 61/681,696, filed Aug. 10, 2012, entitled Modified Polynucleotides for the Production of Proteins Associated with Human Disease; U.S. Provisional Patent Application No. 61/737,191, filed Dec. 14, 2012, entitled Modified Polynucleotides for the Production of Proteins Associated with Human Disease; U.S. Provisional Patent Application No. 61/618,953, filed Apr. 2, 2012, entitled Modified Polynucleotides for the Production of Proteins Associated with Human Disease; U.S. Provisional Patent Application No. 61/681,704, filed Aug. 10, 2012, entitled Modified Polynucleotides for the Production of Proteins Associated with Human Disease; U.S. Provisional Patent Application No. 61/737,203, filed Dec. 14, 2012, entitled Modified Polynucleotides for the Production of Proteins Associated with Human Disease; U.S. Provisional Patent Application No. 61/681,720, filed Aug. 10, 2012, entitled Modified Polynucleotides for the Production of Cosmetic Proteins and Peptides; U.S. Provisional Patent Application No. 61/737,213, filed Dec. 14, 2012, entitled Modified Polynucleotides for the Production of Cosmetic Proteins and Peptides; U.S. Provisional Patent Application No. 61/681,742, filed Aug. 10, 2012, entitled Modified Polynucleotides for the Production of Oncology-Related Proteins and Peptides; International Application No PCT/US2013/030062, filed Mar. 9, 2013, entitled Modified Polynucleotides for the Production of Biologics and Proteins Associated with Human Disease; U.S. patent application Ser. No. 13/791,922, filed Mar. 9, 2013, entitled Modified Polynucleotides for the Production of Biologics and Proteins Associated with Human Disease; International Application No PCT/US2013/030063, filed Mar. 9, 2013, entitled Modified Polynucleotides; International Application No. PCT/US2013/030064, entitled Modified Polynucleotides for the Production of Secreted Proteins; U.S. patent application Ser. No. 13/791,921, filed Mar. 9, 2013, entitled Modified Polynucleotides for the Production of Secreted Proteins; International Application No PCT/US2013/030059, filed Mar. 9, 2013, entitled Modified Polynucleotides for the Production of Membrane Proteins; International Application No. PCT/US2013/030066, filed Mar. 9, 2013, entitled Modified Polynucleotides for the Production of Cytoplasmic and Cytoskeletal Proteins; International Application No. PCT/US2013/030067, filed Mar. 9, 2013, entitled Modified Polynucleotides for the Production of Nuclear Proteins; International Application No. PCT/US2013/030060, filed Mar. 9, 2013, entitled Modified Polynucleotides for the Production of Proteins; International Application No. PCT/US2013/030061, filed Mar. 9, 2013, entitled Modified Polynucleotides for the Production of Proteins Associated with Human Disease; U.S. patent application Ser. No. 13/791,910, filed Mar. 9, 2013, entitled Modified Polynucleotides for the Production of Proteins Associated with Human Disease; International Application No. PCT/US2013/030068, filed Mar. 9, 2013, entitled Modified Polynucleotides for the Production of Cosmetic Proteins and Peptides; and International Application No. PCT/US2013/030070, filed Mar. 9, 2013, entitled Modified Polynucleotides for the Production of Oncology-Related Proteins and Peptides; International Patent Application No. PCT/US2013/031821, filed Mar. 15, 2013, entitled In Vivo Production of Proteins; the contents of each of which are herein incorporated by reference in their entireties.

Formulations and delivery of modified polynucleotides are described in, for example, co-pending and co-owned International Publication No WO2013090648, filed Dec. 14, 2012, entitled Modified Nucleoside, Nucleotide, Nucleic Acid Compositions and US Publication No US20130156849, filed Dec. 14, 2012, entitled Modified Nucleoside, Nucleotide, Nucleic Acid Compositions; the contents of each of which are herein incorporated by reference in their entireties.

There is a need in the art, therefore, for biological modalities to address the modulation of intracellular translation of nucleic acids. The present invention addresses this need by providing methods and compositions for the manufacture and optimization of modified mRNA molecules via alteration of the terminal architecture of the molecules.

SUMMARY OF THE INVENTION

Disclosed herein are methods of stabilizing or inducing increased protein expression from a modified mRNA. In another method, a cell is contacted with a modified mRNA encoding a polypeptide of interest in combination with a modified mRNA encoding one or more RNA binding proteins.

In one embodiment, provided herein are terminally optimized mRNA comprising first region of linked nucleosides encoding a polypeptide of interest which is located 5' relative to the first region, a second terminal region located 3' relative to the first terminal region and a 3' tailing region. The first terminal region may comprise at least one translation enhancer element (TEE) such as, but not limited to, the TEEs described in Table 28 such as, but not limited to, TEE-001-TEE-705.

The first terminal region may comprise a 5' untranslated region (UTR) which may be the native 5'UTR of the encoded polypeptide of interest or may be heterologous to the encoded polypeptide of interest. In one aspect, the 5'UTR may comprise at least one translation initiation sequence such as a kozak sequence, an internal ribosome entry site (IRES) and/or a fragment thereof. As a non-limiting example, the 5'UTR may comprise at least one fragment of an IRES. As another non-limiting example, the 5'UTR may comprise at least 5 fragments of an IRES. In another aspect, the 5'UTR may comprise a structured UTR.

The second terminal region may comprise at least one microRNA binding site, seed sequence or microRNA binding site without a seed sequence. In one aspect, the microRNA is an immune cell specific microRNA such as, but not limited to, mir-122, miR-142-3p, miR-142-5p, miR-146a and miR-146b.

In one embodiment, the 3' tailing region may comprise a chain terminating nucleoside such as, but not limited to, 3'-deoxyadenosine (cordycepin), 3'-deoxyuridine, 3'-deoxycytosine, 3'-deoxyguanosine, 3'-deoxythymine, 2',3'-dideoxynucleosides, 2',3'-dideoxyadenosine, 2',3'-dideoxyuridine, 2',3'-dideoxycytosine, 2',3'-dideoxyguanosine, 2',3'-dideoxythymine, a 2'-deoxynucleoside, and —O— methylnucleoside. In one aspect, the 3' tailing region is a stem loop sequence or a polyA tail.

In one embodiment, provided herein are terminally optimized mRNA comprising first region of linked nucleosides encoding a polypeptide of interest which is located 5' relative to the first region, a second terminal region located 3' relative to the first terminal region and a 3' tailing region of linked nucleosides and at least one chain terminating nucleoside located 3' relative to the terminally optimized mRNA. In one aspect, the second terminal region may comprise at least one microRNA binding site, seed sequence or microRNA binding site without a seed sequence. In one aspect, the microRNA is an immune cell specific microRNA such as, but not limited to, mir-122, miR-142-3p, miR-142-5p, miR-146a and miR-146b.

The terminally optimized mRNA described herein may comprise at least one modified nucleoside. In one embodiment, the terminally optimized mRNA comprises a pseudouridine analog such as, but not limited to, 1-carboxymethyl-pseudouridine, 1-propynyl-pseudouridine, 1-taurinomethyl-pseudouridine, 1-taurinomethyl-4-thio-pseudouridine, 1-methyl-pseudouridine (m$^1$ψ), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine (acp$^3$ψ), and 2'-O-methyl-pseudouridine (ψm). In another embodiment, the terminally optimized mRNA comprises the pseudouridine analog 1-methylpseudouridine. In yet another embodiment, the terminally optimized mRNA comprises the pseudouridine analog 1-methylpseudouridine and comprises the modified nucleoside 5-methylcytidine.

The terminally optimized mRNA described herein may comprise at least one 5' cap structure such as, but not limited to, Cap0, Cap1, ARCA, inosine, N1-methyl-guanosine, 2' fluoro-guanosine, 7-deaza-guanosine, 8-oxo-guanosine, 2-amino-guanosine, LNA-guanosine, 2-azido-guanosine, Cap2, Cap4, and CAP-003-CAP-225.

In one aspect, at least one region of the terminally optimized mRNA may be codon optimized. As a non-limiting example, the first region of linked nucleosides may be codon optimized.

Also provided herein are methods of using the terminally optimized mRNA.

In one embodiment, provided is a method of reducing antigen-mediated immune response in an organism by contacting the organism with a terminally optimized mRNA. The terminally optimized mRNA may comprise a first region of linked nucleosides encoding a polypeptide of interest which is located 5' relative to the first region, a second terminal region located 3' relative to the first terminal region and a 3'tailing region. The second terminal region may comprise at least one microRNA binding site, seed sequence or microRNA binding site without a seed sequence. In one aspect, the microRNA is an immune cell specific microRNA such as, but not limited to, mir-122, miR-142-3p, miR-142-5p, miR-146a and miR-146b.

In a another embodiment, terminally optimized mRNA which reduces the antigen-mediated immune response may comprise at least one translation enhancer element (TEE) sequence such as, but not limited to, TEE-001-TEE 705, a chain terminating nucleoside and/or a stem loop sequence.

In yet another embodiment, terminally optimized mRNA which reduces the antigen-mediated immune response may comprise at least one region which is codon optimized. As a non-limiting example, the first region of linked nucleosides may be codon optimized.

The details of various embodiments of the invention are set forth in the description below. Other features, objects, and advantages of the invention will be apparent from the description and the drawings, and from the claims.

DETAILED DESCRIPTION

Figure 1:
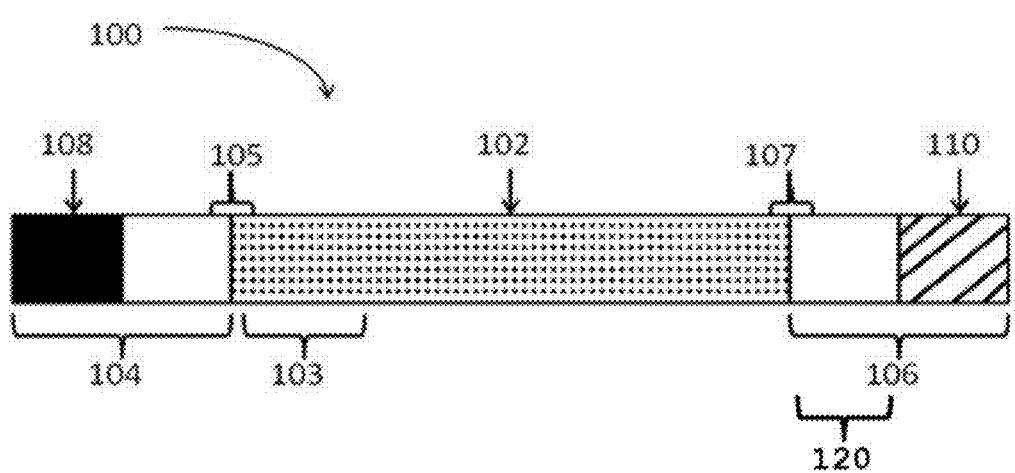
FIG. 1 is a schematic of a primary construct of the present invention.

Described herein are compositions and methods for the manufacture and optimization of modified mRNA molecules via alteration of the terminal architecture of the molecules. Specifically disclosed are methods for increasing protein production by altering the terminal regions of the mRNA. Such terminal regions include at least the 5' untranslated region (UTR), and 3'UTR. Other features which may be modified and found to the 5' or 3' of the coding region include the 5' cap and poly-A tail of the modified mRNAs (modified RNAs).

In general, exogenous nucleic acids, particularly viral nucleic acids, introduced into cells induce an innate immune response, resulting in interferon (IFN) production and cell death. However, it is of great interest for therapeutics, diagnostics, reagents and for biological assays to deliver a nucleic acid, e.g., a ribonucleic acid (RNA) inside a cell, either in vivo or ex vivo, such as to cause intracellular translation of the nucleic acid and production of the encoded protein. Of particular importance is the delivery and function of a non-integrative nucleic acid, as nucleic acids characterized by integration into a target cell are generally imprecise in their expression levels, deleteriously transferable to progeny and neighbor cells, and suffer from the substantial risk of mutation.

The terminal modification described herein may be used in the modified nucleic acids encoding polypeptides of interest, such as, but not limited to, the polypeptides of interest described in, U.S. Provisional Patent Application No. 61/618,862, filed Apr. 2, 2012, entitled Modified Polynucleotides for the Production of Biologics, U.S. Provisional Patent Application No. 61/681,645, filed Aug. 10, 2012, entitled Modified Polynucleotides for the Production of Biologics, U.S. Provisional Patent Application No. 61/737,130, filed Dec. 14, 2012, entitled Modified Polynucleotides for the Production of Biologics, U.S. Provisional Patent Application No. 61/618,866, filed Apr. 2, 2012, entitled Modified Polynucleotides for the Production of Antibodies, U.S. Provisional Patent Application No. 61/681,647, filed Aug. 10, 2012, entitled Modified Polynucleotides for the Production of Antibodies, U.S. Provisional Patent Application No. 61/737,134, filed Dec. 14, 2012, entitled Modified Polynucleotides for the Production of Antibodies, U.S. Provisional Patent Application No. 61/618,868, filed Apr. 2, 2012, entitled Modified Polynucleotides for the Production of Vaccines, U.S. Provisional Patent Application No. 61/681,648, filed Aug. 10, 2012, entitled Modified Polynucleotides for the Production of Vaccines, U.S. Provisional Patent Application No. 61/737,135, filed Dec. 14, 2012, entitled Modified Polynucleotides for the Production of Vaccines, U.S. Provisional Patent Application No. 61/618,870, filed Apr. 2, 2012, entitled Modified Polynucleotides for the Production of Therapeutic Proteins and Peptides, U.S. Provisional Patent Application No. 61/681,649, filed Aug. 10, 2012, entitled Modified Polynucleotides for the Production of Therapeutic Proteins and Peptides, U.S. Provisional Patent Application No. 61/737,139, filed Dec. 14, 2012, Modified Polynucleotides for the Production of Therapeutic Proteins and Peptides, U.S. Provisional Patent Application No. 61/618,873, filed Apr. 2, 2012, entitled Modified Polynucleotides for the Production of Secreted Proteins, U.S. Provisional Patent Application No. 61/681,650, filed Aug. 10, 2012, entitled Modified Polynucleotides for the Production of Secreted Proteins, U.S. Provisional Patent Application No. 61/737,147, filed Dec. 14, 2012, entitled Modified Polynucleotides for the Production of Secreted Proteins, U.S. Provisional Patent Application No. 61/618,878, filed Apr. 2, 2012, entitled Modified Polynucleotides for the Production of Plasma Membrane Proteins, U.S. Provisional Patent Application No. 61/681,654, filed Aug. 10, 2012, entitled Modified Polynucleotides for the Production of Plasma Membrane Proteins, U.S. Provisional Patent Application No. 61/737,152, filed Dec. 14, 2012, entitled Modified Polynucleotides for the Production of Plasma Membrane Proteins, U.S. Provisional Patent Application No. 61/618,885, filed Apr. 2, 2012, entitled Modified Polynucleotides for the Production of Cytoplasmic and Cytoskeletal Proteins, U.S. Provisional Patent Application No. 61/681,658, filed Aug. 10, 2012, entitled Modified Polynucleotides for the Production of Cytoplasmic and Cytoskeletal Proteins, U.S. Provisional Patent Application No. 61/737,155, filed Dec. 14, 2012, entitled Modified Polynucleotides for the Production of Cytoplasmic and Cytoskeletal Proteins, U.S. Provisional Patent Application No. 61/618,896, filed Apr. 2, 2012, entitled Modified Polynucleotides for the Production of Intracellular Membrane Bound Proteins, U.S. Provisional Patent Application No. 61/668,157, filed Jul. 5, 2012, entitled Modified Polynucleotides for the Production of Intracellular Membrane Bound Proteins, U.S. Provisional Patent Application No. 61/681,661, filed Aug. 10, 2012, entitled Modified Polynucleotides for the Production of Intracellular Membrane Bound Proteins, U.S. Provisional Patent Application No. 61/737,160, filed Dec. 14, 2012, entitled Modified Polynucleotides for the Production of Intracellular Membrane Bound Proteins, U.S. Provisional Patent Application No. 61/618,911, filed Apr. 2, 2012, entitled Modified Polynucleotides for the Production of Nuclear Proteins, U.S. Provisional Patent Application No. 61/681,667, filed Aug. 10, 2012, entitled Modified Polynucleotides for the Production of Nuclear Proteins, U.S. Provisional Patent Application No. 61/737,168, filed Dec. 14, 2012, entitled Modified Polynucleotides for the Production of Nuclear Proteins, U.S. Provisional Patent Application No. 61/618,922, filed Apr. 2, 2012, entitled Modified Polynucleotides for the Production of Proteins, U.S. Provisional Patent Application No. 61/681,675, filed Aug. 10, 2012, entitled Modified Polynucleotides for the Production of Proteins, U.S. Provisional Patent Application No. 61/737,174, filed Dec. 14, 2012, entitled Modified Polynucleotides for the Production of Proteins, U.S. Provisional Patent Application No. 61/618,935, filed Apr. 2, 2012, entitled Modified Polynucleotides for the Production of Proteins Associated with Human Disease, U.S. Provisional Patent Application No. 61/681,687, filed Aug. 10, 2012, entitled Modified Polynucleotides for the Production of Proteins Associated with Human Disease, U.S. Provisional Patent Application No. 61/737,184, filed Dec. 14, 2012, entitled Modified Polynucleotides for the Production of Proteins Associated with Human Disease, U.S. Provisional Patent Application No. 61/618,945, filed Apr. 2, 2012, entitled Modified Polynucleotides for the Production of Proteins Associated with Human Disease, U.S. Provisional Patent Application No. 61/681,696, filed Aug. 10, 2012, entitled Modified Polynucleotides for the Production of Proteins Associated with Human Disease, U.S. Provisional Patent Application No. 61/737,191, filed Dec. 14, 2012, entitled Modified Polynucleotides for the Production of Proteins Associated with Human Disease, U.S. Patent Application No. 61/618,953, filed Apr. 2, 2012, entitled Modified Polynucleotides for the Production of Proteins Associated with Human Disease, U.S. Patent Application No. 61/681,704, filed Aug. 10, 2012, entitled Modified Polynucleotides for the Production of Proteins Associated with Human Disease, U.S. Patent Application No. 61/737,203, filed Dec. 14, 2012, entitled Modified Polynucleotides for the Production of Proteins Associated with Human Disease, International Application No PCT/US2013/030062, filed Mar. 9, 2013, entitled Modified Polynucleotides for the Production of Biologics and Proteins Associated with Human Disease; International Application No PCT/US2013/030063, filed Mar. 9, 2013, entitled Modified Polynucleotides; International Application No. PCT/US2013/030064, entitled Modified Polynucleotides for the Production of Secreted Proteins; International Application No PCT/US2013/030059, filed Mar. 9, 2013, entitled Modified Polynucleotides for the Production of Membrane Proteins; International Application No. PCT/US2013/030066, filed Mar. 9, 2013, entitled Modified Polynucleotides for the Production of Cytoplasmic and Cytoskeletal Proteins; International Application No. PCT/US2013/030067, filed Mar. 9, 2013, entitled Modified Polynucleotides for the Production of Nuclear Proteins; International Application No. PCT/US2013/030060, filed Mar. 9, 2013, entitled Modified Polynucleotides for the Production of Proteins; International Application No. PCT/US2013/030061, filed Mar. 9, 2013, entitled Modified Polynucleotides for the Production of Proteins Associated with Human Disease; International Application No. PCT/US2013/030068, filed Mar. 9, 2013, entitled Modified Polynucleotides for the Production of Cosmetic Proteins and Peptides; International Application No. PCT/US2013/030070, filed Mar. 9, 2013, entitled Modified Polynucleotides for the Production of Oncology-Related Proteins and Peptides; and International Application No. PCT/US2013/031821, filed Mar. 15, 2013, entitled In Vivo Production of Proteins, U.S. Provisional Patent Application No. 61/753,661, filed Jan. 17, 2013, entitled Signal-Sensor Polynucleotide for the Alteration of Cellular Phenotypes and Microenvironments, U.S. Provisional Patent Application No. 61/754,159, filed Jan. 18, 2013, entitled Signal-Sensor Polynucleotide for the Alteration of Cellular Phenotypes and Microenvironments, U.S. Provisional Patent Application No. 61/781,097, filed Mar. 14, 2013, entitled Signal-Sensor Polynucleotide for the Alteration of Cellular Phenotypes and Microenvironments, U.S. Provisional Patent Application No. 61/829,334, filed May 31, 2013, entitled Signal-Sensor Polynucleotide for the Alteration of Cellular Phenotypes and Microenvironments, U.S. Provisional Patent Application No. 61/729,933, filed Nov. 26, 2012, entitled Terminally Optimized Modified RNAs, U.S. Provisional Patent Application No. 61/737,224, filed Dec. 14, 2012, entitled Terminally Optimized Modified RNAs, U.S. Provisional Patent Application No. 61/758,921, filed Jan. 31, 2013, entitled Differential Targeting Using RNA Constructs, U.S. Provisional Patent Application No. 61/781,139, filed Mar. 14, 2013, entitled Differential Targeting Using RNA Constructs, U.S. Provisional Application No. 61/829,359, filed May 31, 2013, entitled Differential Targeting Using RNA Constructs, the contents of each of which are herein incorporated by reference in their entireties.

Provided herein in part are nucleic acid molecules encoding polypeptides capable of modulating a cell's status, function and/or activity, and methods of making and using these nucleic acids and polypeptides. As described herein and in co-pending and co-owned International Publication No WO2012019168 filed Aug. 5, 2011, International Publication No WO2012045082 filed Oct. 3, 2011, International Publication No WO2012045075 filed Oct. 3, 2011, International Publication No WO2013052523 filed Oct. 3, 2012, and International Publication No WO2013090648 filed Dec. 14, 2012, the contents of each of which are incorporated by reference herein in their entirety, these modified nucleic acid molecules are capable of reducing the innate immune activity of a population of cells into which they are introduced, thus increasing the efficiency of protein production in that cell population.

In addition to utilization of non-natural nucleosides and nucleotides, such as those described in US Patent Publication No US20130115272, filed Oct. 3, 2012 (the contents of which are herein incorporated by reference in its entirety), in the modified RNAs of the present invention, it has now been discovered that concomitant use of altered terminal architecture may also serve to increase protein production from a cell population.

I. Compositions of the Invention

This invention provides nucleic acid molecules, including RNAs such as mRNAs, which may be synthetic, that contain one or more modified nucleosides (termed "modified nucleic acids" or "modified nucleic acid molecules") and polynucleotides, primary constructs and modified mRNA (mmRNA), which have useful properties including the lack of a substantial induction of the innate immune response of a cell into which the mRNA is introduced. Because these modified nucleic acids enhance the efficiency of protein production, intracellular retention of nucleic acids, and viability of contacted cells, as well as possess reduced immunogenicity, these nucleic acids having these properties are termed "enhanced" nucleic acids or modified RNAs herein.

In one embodiment, the polynucleotides are nucleic acid transcripts which encode one or more polypeptides of interest that, when translated, deliver a signal to the cell which results in the therapeutic benefit to the organism. The signal polynucleotides may optionally further comprise a sequence (translatable or not) which sense the microenvironment of the polynucleotide and alters (a) the function or phenotype outcome associated with the peptide or protein which is translated, (b) the expression level of the signal polynucleotide, and/or both.

The term "nucleic acid," in its broadest sense, includes any compound and/or substance that comprise a polymer of nucleotides. These polymers are often referred to as polynucleotides.

Exemplary nucleic acids include ribonucleic acids (RNAs), deoxyribonucleic acids (DNAs), threose nucleic acids (TNAs), glycol nucleic acids (GNAs), peptide nucleic acids (PNAs), locked nucleic acids (LNAs) or hybrids thereof. They may also include RNAi-inducing agents, RNAi agents, siRNAs, shRNAs, miRNAs, antisense RNAs, ribozymes, catalytic DNA, tRNA, RNAs that induce triple helix formation, aptamers, vectors, etc. In preferred embodiments, the modified nucleic acid molecule is one or more messenger RNAs (mRNAs).

In preferred embodiments, the polynucleotide or nucleic acid molecule is a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Polynucleotides of the invention may be mRNA or any nucleic acid molecule and may or may not be chemically modified.

Traditionally, the basic components of an mRNA molecule include at least a coding region, a 5'UTR, a 3'UTR, a 5' cap and a poly-A tail. Building on this wild type modular structure, the present invention expands the scope of functionality of traditional mRNA molecules by providing polynucleotides or primary RNA constructs which maintain a modular organization, but which comprise one or more structural and/or chemical modifications or alterations which impart useful properties to the polynucleotide including, in some embodiments, the lack of a substantial induction of the innate immune response of a cell into which the polynucleotide is introduced. As such, modified mRNA molecules of the present invention, which may be synthetic, are termed "mmRNA." As used herein, a "structural" feature or modification is one in which two or more linked nucleotides are inserted, deleted, duplicated, inverted or randomized in a polynucleotide polynucleotide, primary construct or mmRNA without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATC-CCG". Here, the dinucleotide "CC" has been inserted, resulting in a structural modification to the polynucleotide.

Provided are modified nucleic acids containing a translatable region and one, two, or more than two different nucleoside modifications. In some embodiments, the modified nucleic acid exhibits reduced degradation in a cell into which the nucleic acid is introduced, relative to a corresponding unmodified nucleic acid.

In some embodiments, the chemical modifications can be located on the sugar moiety of the nucleotide In some embodiments, the chemical modifications can be located on the phosphate backbone of the nucleotide In certain embodiments it is desirable to intracellularly degrade a modified nucleic acid introduced into the cell, for example if precise timing of protein production is desired. Thus, the invention provides a modified nucleic acid containing a degradation domain, which is capable of being acted on in a directed manner within a cell.

Polynucleotide, Primary Construct or mmRNA Architecture

The polynucleotides of the present invention are distinguished from wild type mRNA in their functional and/or structural design features which serve to, as evidenced herein, overcome existing problems of effective polypeptide production using nucleic acid-based therapeutics.

FIG. 1 shows a representative primary construct 100 of the present invention. As used herein, the term "primary construct" or "primary mRNA construct" refers to polynucleotide transcript which encodes one or more polypeptides of interest and which retains sufficient structural and/or chemical features to allow the polypeptide of interest encoded therein to be translated. Primary constructs may be polynucleotides of the invention. When structurally or chemically modified, the primary construct may be referred to as a mmRNA.

Returning to FIG. 1, the primary construct 100 here contains a first region of linked nucleotides 102 that is flanked by a first flanking region 104 and a second flaking region 106. As used herein, the "first region" may be referred to as a "coding region" or "region encoding" or simply the "first region." This first region may include, but is not limited to, the encoded polypeptide of interest. The polypeptide of interest may comprise at its 5' terminus one or more signal peptide sequences encoded by a signal peptide sequence region 103. The flanking region 104 may comprise a region of linked nucleotides comprising one or more complete or incomplete 5' UTRs sequences. The flanking region 104 may also comprise a 5' terminal cap 108. The second flanking region 106 may comprise a region of linked nucleotides comprising one or more complete or incomplete 3' UTRs. The flanking region 106 may also comprise a 3' tailing sequence 110 and a 3'UTR 120.

Bridging the 5' terminus of the first region 102 and the first flanking region 104 is a first operational region 105. Traditionally this operational region comprises a start codon. The operational region may alternatively comprise any translation initiation sequence or signal including a start codon.

Bridging the 3' terminus of the first region 102 and the second flanking region 106 is a second operational region 107. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" and the second stop codon may be selected from the group consisting of "TAA," "TGA" and "TAG." The operation region may further comprise three stop codons. The third stop codon may be selected from the group consisting of "TAA," "TGA" and "TAG."

Figure 2:
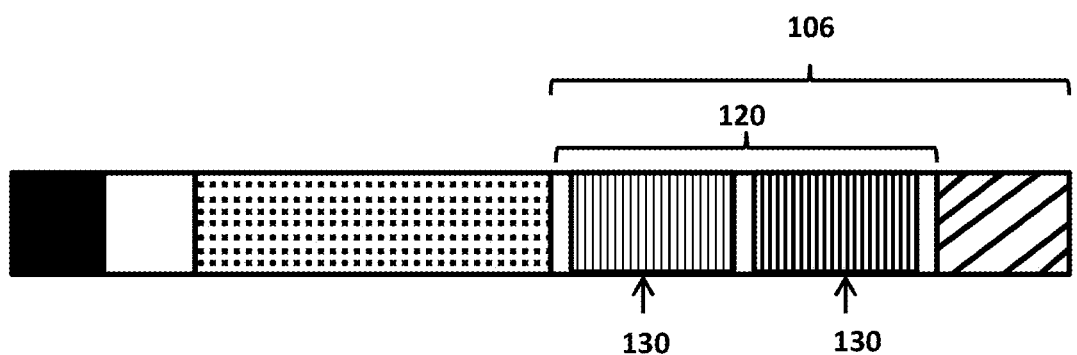
FIG. 2 is an expanded schematic of the second flanking region of a primary construct of the present invention illustrating the sensor elements of the polynucleotide.

Turning to FIG. 2, the 3'UTR 120 of the second flanking region 106 may comprise one or more sensor sequences 130. These sensor sequences as discussed herein operate as pseudo-receptors (or binding sites) for ligands of the local microenvironment of the primary construct or polynucleotide. For example, microRNA binding sites or miRNA seeds may be used as sensors such that they function as pseudoreceptors for any microRNAs present in the environment of the polynucleotide.

Generally, the shortest length of the first region of the primary construct of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

Generally, the length of the first region encoding the polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, the "first region" may be referred to as a "coding region" or "region encoding" or simply the "first region."

In some embodiments, the polynucleotide, primary construct, or mmRNA includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, the first and second flanking regions may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, the tailing sequence may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA binding protein binding. In this embodiment, the polyA tail is long enough to bind at least 4 monomers of polyA binding protein. PolyA binding protein monomers bind to stretches of approximately 38 nucleotides. As such, it has been observed that polyA tails of about 80 nucleotides and 160 nucleotides are functional.

According to the present invention, the capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions may range from 3 to 40, e.g., 5-30, 10-20, 15, or at least 4, or 30 or fewer nucleotides in length and may comprise, in addition to a start and/or stop codon, one or more signal and/or restriction sequences.

Cyclic Polynucleotides

According to the present invention, a nucleic acid, modified RNA or primary construct may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, 1 μg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split oligonucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

Polynucleotide Multimers

According to the present invention, multiple distinct nucleic acids, modified RNA or primary constructs may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into HepG2 cells at a 1:1 ratio to alter cellular fatty acid metabolism. This ratio may be controlled by chemically linking nucleic acids or modified RNA using a 3'-azido terminated nucleotide on one nucleic acids or modified RNA species and a C5-ethynyl or alkynyl-containing nucleotide on the opposite nucleic acids or modified RNA species. The modified nucleotide is added post-transcriptionally using terminal transferase (New England Biolabs, Ipswich, Mass.) according to the manufacturer's protocol. After the addition of the 3'-modified nucleotide, the two nucleic acids or modified RNA species may be combined in an aqueous solution, in the presence or absence of copper, to form a new covalent linkage via a click chemistry mechanism as described in the literature.

In another example, more than two polynucleotides may be linked together using a functionalized linker molecule. For example, a functionalized saccharide molecule may be chemically modified to contain multiple chemical reactive groups (SH—, $NH_2$—, $N_3$, etc. ... ) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated nucleic acid or mRNA.

Modified RNA Conjugates and Combinations

In order to further enhance protein production, nucleic acids, modified RNA, polynucleotides or primary constructs of the present invention can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation may result in increased stability and/or half life and may be particularly useful in targeting the nucleic acids, modified RNA, polynucleotides or primary constructs to specific sites in the cell, tissue or organism.

According to the present invention, the nucleic acids, modified RNA or primary construct may be administered with, or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

Bifunctional Polynucleotides

In one embodiment of the invention are bifunctional polynucleotides (e.g., bifunctional nucleic acids, bifunctional modified RNA or bifunctional primary constructs). As the name implies, bifunctional polynucleotides are those having or capable of at least two functions. These molecules may also by convention be referred to as multi-functional.

The multiple functionalities of bifunctional polynucleotides may be encoded by the RNA (the function may not manifest until the encoded product is translated) or may be a property of the polynucleotide itself. It may be structural or chemical. Bifunctional modified polynucleotides may comprise a function that is covalently or electrostatically associated with the polynucleotides. Further, the two functions may be provided in the context of a complex of a modified RNA and another molecule.

Bifunctional polynucleotides may encode peptides which are anti-proliferative. These peptides may be linear, cyclic, constrained or random coil. They may function as aptamers, signaling molecules, ligands or mimics or mimetics thereof. Anti-proliferative peptides may, as translated, be from 3 to 50 amino acids in length. They may be 5-40, 10-30, or approximately 15 amino acids long. They may be single chain, multichain or branched and may form complexes, aggregates or any multi-unit structure once translated.

Noncoding Polynucleotides

As described herein, provided are nucleic acids, modified RNA, polynucleotides and primary constructs having sequences that are partially or substantially not translatable, e.g., having a noncoding region. Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The nucleic acids, polynucleotides, primary constructs or mRNA may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA).

Polypeptides of Interest

According to the present invention, the primary construct is designed to encode one or more polypeptides of interest or fragments thereof. A polypeptide of interest may include, but is not limited to, whole polypeptides, a plurality of polypeptides or fragments of polypeptides, which independently may be encoded by one or more nucleic acids, a plurality of nucleic acids, fragments of nucleic acids or variants of any of the aforementioned. As used herein, the term "polypeptides of interest" refers to any polypeptide which is selected to be encoded in the primary construct of the present invention. As used herein, "polypeptide" means a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding polypeptides of interest containing substitutions, insertions and/or additions, deletions and covalent modifications with respect to reference sequences are included within the scope of this invention. For example, sequence tags or amino acids, such as one or more lysines, can be added to the peptide sequences of the invention (e.g., at the N-terminal or C-terminal ends).

Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the mmRNA of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biol 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that subdomains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by the primary construct or mmRNA of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis. The resulting modified molecules may then be tested for activity using in vitro or in vivo assays such as those described herein or any other suitable screening assay known in the art.

According to the present invention, the polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of polypeptides of interest of this invention. For example, provided herein is any protein fragment (meaning an polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

Encoded Polypeptides of Interest

The primary constructs, modified nucleic acids or mmRNA of the present invention may be designed to encode polypeptides of interest such as peptides and proteins.

In one embodiment, primary constructs, modified nucleic acids or mmRNA of the present invention may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence. A "reference polypeptide sequence" may, e.g., be any one of the protein sequence listed in U.S. Provisional Patent Application No. 61/618,862, filed Apr. 2, 2012, entitled Modified Polynucleotides for the Production of Biologics, U.S. Provisional Patent Application No. 61/681,645, filed Aug. 10, 2012, entitled Modified Polynucleotides for the Production of Biologics, U.S. Provisional Patent Application No. 61/737,130, filed Dec. 14, 2012, entitled Modified Polynucleotides for the Production of Biologics, U.S. Provisional Patent Application No. 61/618,866, filed Apr. 2, 2012, entitled Modified Polynucleotides for the Production of Antibodies, U.S. Provisional Patent Application No. 61/681,647, filed Aug. 10, 2012, entitled Modified Polynucleotides for the Production of Antibodies, U.S. Provisional Patent Application No. 61/737,134, filed Dec. 14, 2012, entitled Modified Polynucleotides for the Production of Antibodies, U.S. Provisional Patent Application No. 61/618,868, filed Apr. 2, 2012, entitled Modified Polynucleotides for the Production of Vaccines, U.S. Provisional Patent Application No. 61/681,648, filed Aug. 10, 2012, entitled Modified Polynucleotides for the Production of Vaccines, U.S. Provisional Patent Application No. 61/737,135, filed Dec. 14, 2012, entitled Modified Polynucleotides for the Production of Vaccines, U.S. Provisional Patent Application No. 61/618,870, filed Apr. 2, 2012, entitled Modified Polynucleotides for the Production of Therapeutic Proteins and Peptides, U.S. Provisional Patent Application No. 61/681,649, filed Aug. 10, 2012, entitled Modified Polynucleotides for the Production of Therapeutic Proteins and Peptides, U.S. Provisional Patent Application No. 61/737,139, filed Dec. 14, 2012, Modified Polynucleotides for the Production of Therapeutic Proteins and Peptides, U.S. Provisional Patent Application No. 61/618,873, filed Apr. 2, 2012, entitled Modified Polynucleotides for the Production of Secreted Proteins, U.S. Provisional Patent Application No. 61/681,650, filed Aug. 10, 2012, entitled Modified Polynucleotides for the Production of Secreted Proteins, U.S. Provisional Patent Application No. 61/737,147, filed Dec. 14, 2012, entitled Modified Polynucleotides for the Production of Secreted Proteins, U.S. Provisional Patent Application No. 61/618,878, filed Apr. 2, 2012, entitled Modified Polynucleotides for the Production of Plasma Membrane Proteins, U.S. Provisional Patent Application No. 61/681,654, filed Aug. 10, 2012, entitled Modified Polynucleotides for the Production of Plasma Membrane Proteins, U.S. Provisional Patent Application No. 61/737,152, filed Dec. 14, 2012, entitled Modified Polynucleotides for the Production of Plasma Membrane Proteins, U.S. Provisional Patent Application No. 61/618,885, filed Apr. 2, 2012, entitled Modified Polynucleotides for the Production of Cytoplasmic and Cytoskeletal Proteins, U.S. Provisional Patent Application No. 61/681,658, filed Aug. 10, 2012, entitled Modified Polynucleotides for the Production of Cytoplasmic and Cytoskeletal Proteins, U.S. Provisional Patent Application No. 61/737,155, filed Dec. 14, 2012, entitled Modified Polynucleotides for the Production of Cytoplasmic and Cytoskeletal Proteins, U.S. Provisional Patent Application No. 61/618,896, filed Apr. 2, 2012, entitled Modified Polynucleotides for the Production of Intracellular Membrane Bound Proteins, U.S. Provisional Patent Application No. 61/668,157, filed Jul. 5, 2012, entitled Modified Polynucleotides for the Production of Intracellular Membrane Bound Proteins, U.S. Provisional Patent Application No. 61/681,661, filed Aug. 10, 2012, entitled Modified Polynucleotides for the Production of Intracellular Membrane Bound Proteins, U.S. Provisional Patent Application No. 61/737,160, filed Dec. 14, 2012, entitled Modified Polynucleotides for the Production of Intracellular Membrane Bound Proteins, U.S. Provisional Patent Application No. 61/618,911, filed Apr. 2, 2012, entitled Modified Polynucleotides for the Production of Nuclear Proteins, U.S. Provisional Patent Application No. 61/681,667, filed Aug. 10, 2012, entitled Modified Polynucleotides for the Production of Nuclear Proteins, U.S. Provisional Patent Application No. 61/737,168, filed Dec. 14, 2012, entitled Modified Polynucleotides for the Production of Nuclear Proteins, U.S. Provisional Patent Application No. 61/618,922, filed Apr. 2, 2012, entitled Modified Polynucleotides for the Production of Proteins, U.S. Provisional Patent Application No. 61/681,675, filed Aug. 10, 2012, entitled Modified Polynucleotides for the Production of Proteins, U.S. Provisional Patent Application No. 61/737,174, filed Dec. 14, 2012, entitled Modified Polynucleotides for the Production of Proteins, U.S. Provisional Patent Application No. 61/618,935, filed Apr. 2, 2012, entitled Modified Polynucleotides for the Production of Proteins Associated with Human Disease, U.S. Provisional Patent Application No. 61/681,687, filed Aug. 10, 2012, entitled Modified Polynucleotides for the Production of Proteins Associated with Human Disease, U.S. Provisional Patent Application No. 61/737,184, filed Dec. 14, 2012, entitled Modified Polynucleotides for the Production of Proteins Associated with Human Disease, U.S. Provisional Patent Application No. 61/618,945, filed Apr. 2, 2012, entitled Modified Polynucleotides for the Production of Proteins Associated with Human Disease, U.S. Provisional Patent Application No. 61/681,696, filed Aug. 10, 2012, entitled Modified Polynucleotides for the Production of Proteins Associated with Human Disease, U.S. Provisional Patent Application No. 61/737,191, filed Dec. 14, 2012, entitled Modified Polynucleotides for the Production of Proteins Associated with Human Disease, U.S. Patent Application No. 61/618,953, filed Apr. 2, 2012, entitled Modified Polynucleotides for the Production of Proteins Associated with Human Disease, U.S. Patent Application No. 61/681,704, filed Aug. 10, 2012, entitled Modified Polynucleotides for the Production of Proteins Associated with Human Disease, U.S. Patent Application No. 61/737,203, filed Dec. 14, 2012, entitled Modified Polynucleotides for the Production of Proteins Associated with Human Disease, International Application No PCT/US2013/030062, filed Mar. 9, 2013, entitled Modified Polynucleotides for the Production of Biologics and Proteins Associated with Human Disease; International Application No PCT/US2013/030063, filed Mar. 9, 2013, entitled Modified Polynucleotides; International Application No. PCT/US2013/030064, entitled Modified Polynucleotides for the Production of Secreted Proteins; International Application No PCT/US2013/030059, filed Mar. 9, 2013, entitled Modified Polynucleotides for the Production of Membrane Proteins; International Application No. PCT/US2013/030066, filed Mar. 9, 2013, entitled Modified Polynucleotides for the Production of Cytoplasmic and Cytoskeletal Proteins; International Application No. PCT/US2013/030067, filed Mar. 9, 2013, entitled Modified Polynucleotides for the Production of Nuclear Proteins; International Application No. PCT/US2013/030060, filed Mar. 9, 2013, entitled Modified Polynucleotides for the Production of Proteins; International Application No. PCT/US2013/030061, filed Mar. 9, 2013, entitled Modified Polynucleotides for the Production of Proteins Associated with Human Disease; International Application No. PCT/US2013/030068, filed Mar. 9, 2013, entitled Modified Polynucleotides for the Production of Cosmetic Proteins and Peptides; International Application No. PCT/US2013/030070, filed Mar. 9, 2013, entitled Modified Polynucleotides for the Production of Oncology-Related Proteins and Peptides; and International Application No. PCT/US2013/031821, filed Mar. 15, 2013, entitled In Vivo Production of Proteins, the contents of each of which are herein incorporated by reference in their entireties.

The term "identity" as known in the art, refers to a relationship between the sequences of two or more peptides, as determined by comparing the sequences. In the art, identity also means the degree of sequence relatedness between peptides, as determined by the number of matches between strings of two or more amino acid residues. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the polypeptide variant may have the same or a similar activity as the reference polypeptide. Alternatively, the variant may have an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., *Homo sapiens*.

In one embodiment, the polynucleotides, primary constructs, modified nucleic acids and/or mmRNA may be used to treat a disease, disorder and/or condition in a subject.

In one embodiment, the polynucleotides, primary constructs, modified nucleic acids and/or mmRNA may be used to reduce, eliminate or prevent tumor growth in a subject.

In one embodiment, the polynucleotides, primary constructs and/or mmRNA may be used to reduce and/or ameliorate at least one symptom of cancer in a subject. A symptom of cancer may include, but is not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness. Further, the polynucleotides, primary constructs, modified nucleic acid and/or mmRNA may reduce a side-effect associated with cancer such as, but not limited to, chemo brain, peripheral neuropathy, fatigue, depression, nausea, vomiting, pain, anemia, lymphedema, infections, sexual side effects, reduced fertility or infertility, ostomics, insomnia and hair loss.

Terminal Architecture Modifications: Untranslated Regions (UTRs)

Untranslated regions (UTRs) of a gene are transcribed but not translated. The 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the nucleic acids or modified RNA of the present invention to enhance the stability of the molecule. The specific features can also be incorporated to ensure controlled down-regulation of the transcript in case they are misdirected to undesired organs sites. The untranslated regions may be incorporated into a vector system which can produce mRNA and/or be delivered to a cell, tissue and/or organism to produce a polypeptide of interest.

5' UTR and Translation Initiation

Natural 5'UTRs bear features which play roles in for translation initiation. They harbor signatures like Kozak sequences which are commonly known to be involved in the process by which the ribosome initiates translation of many genes. Kozak sequences have the consensus CCR(A/G) CCAUGG, where R is a purine (adenine or guanine) three bases upstream of the start codon (AUG), which is followed by another 'G'. 5'UTR also have been known to form secondary structures which are involved in elongation factor binding.

5'UTR secondary structures involved in elongation factor binding can interact with other RNA binding molecules in the 5'UTR or 3'UTR to regulate gene expression. For example, the elongation factor EIF4A2 binding to a secondarily structured element in the 5'UTR is necessary for microRNA mediated repression (Meijer H A et al., Science, 2013, 340, 82-85, herein incorporated by reference in its entirety). The different secondary structures in the 5'UTR can be incorporated into the flanking region to either stabilize or selectively destalized mRNAs in specific tissues or cells.

By engineering the features typically found in abundantly expressed genes of specific target organs, one can enhance the stability and protein production of the nucleic acids or mRNA of the invention. For example, introduction of 5' UTR of liver-expressed mRNA, such as albumin, serum amyloid A, Apolipoprotein A/B/E, transferrin, alpha fetoprotein, erythropoietin, or Factor VIII, could be used to enhance expression of a nucleic acid molecule, such as a mmRNA, in hepatic cell lines or liver. Likewise, use of 5' UTR from other tissue-specific mRNA to improve expression in that tissue is possible—for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D).

Other non-UTR sequences may be incorporated into the 5' (or 3' UTR) UTRs. For example, introns or portions of introns sequences may be incorporated into the flanking regions of the nucleic acids or mRNA of the invention. Incorporation of intronic sequences may increase protein production as well as mRNA levels.

In one embodiment, at least one fragment of IRES sequences from a GTX gene may be included in the 5'UTR. As a non-limiting example, the fragment may be an 18 nucleotide sequence from the IRES of the GTX gene. As another non-limiting example, an 18 nucleotide sequence fragment from the IRES sequence of a GTX gene may be tandemly repeated in the 5'UTR of a polynucleotide described herein. The 18 nucleotide sequence may be repeated in the 5'UTR at least one, at least twice, at least three times, at least four times, at least five times, at least six times, at least seven times, at least eight times, at least nine times or more than ten times In one embodiment, a 5'UTR may include at least five 18 nucleotide fragments of IRES sequences from a GTX gene may be included in the 5'UTR (see e.g., the 18 nucleotide fragment described in Table 62).

Nucleotides may be mutated, replaced and/or removed from the 5' (or 3') UTRs. For example, one or more nucleotides upstream of the start codon may be replaced with another nucleotide. The nucleotide or nucleotides to be replaced may be 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60 or more than 60 nucleotides upstream of the start codon. As another example, one or more nucleotides upstream of the start codon may be removed from the UTR.

In one embodiment, at least one purine upstream of the start codon may be replaced with a pyrimidine. The purine to be replaced may be 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60 or more than 60 nucleotides upstream of the start codon. As a non-limiting example, an adenine which is three nucleotides upstream of the start codon may be replaced with a thymine. As another non-limiting example, an adenine which is nine nucleotides upstream of the start codon may be replaced with a thymine.

In one embodiment, at least one nucleotide upstream of the start codon may be removed from the UTR. In one aspect, 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60 or more than 60 nucleotides upstream of the start codon may be removed from the UTR of the polynucleotides described herein. As a non-limiting example, the nine nucleotides upstream of the start codon may be removed from the UTR (See e.g., the G-CSF 9de15' construct described in Table 60). 5'UTR, 3'UTR and Translation Enhancer Elements (TEEs)

In one embodiment, the 5'UTR of the polynucleotides, primary constructs, modified nucleic acids and/or mmRNA may include at least one translational enhancer polynucleotide, translation enhancer element, translational enhancer elements (collectively referred to as "TEE"s). As a non-limiting example, the TEE may be located between the transcription promoter and the start codon. The polynucleotides, primary constructs, modified nucleic acids and/or mmRNA with at least one TEE in the 5'UTR may include a cap at the 5'UTR. Further, at least one TEE may be located in the 5'UTR of polynucleotides, primary constructs, modified nucleic acids and/or mmRNA undergoing cap-dependent or cap-independent translation.

The term "translational enhancer element" or "translation enhancer element" (herein collectively referred to as "TEE") refers to sequences that increase the amount of polypeptide or protein produced from an mRNA.

In one aspect, TEEs are conserved elements in the UTR which can promote translational activity of a nucleic acid such as, but not limited to, cap-dependent or cap-independent translation. The conservation of these sequences has been previously shown by Panek et al (Nucleic Acids Research, 2013, 1-10; herein incorporated by reference in its entirety) across 14 species including humans.

In one embodiment, the TEE may be any of the TEEs listed in Table 32 in Example 45, including portion and/or fragments thereof. The TEE sequence may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Table 32 and/or the TEE sequence may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Table 32.

In one non-limiting example, the TEEs known may be in the 5'-leader of the Gtx homeodomain protein (Chappell et al., Proc. Natl. Acad. Sci. USA 101:9590-9594, 2004, herein incorporated by reference in their entirety).

In another non-limiting example, TEEs are disclosed as SEQ ID NOs: 1-35 in US Patent Publication No. US20090226470, SEQ ID NOs: 1-35 in US Patent Publication US20130177581, SEQ ID NOs: 1-35 in International Patent Publication No. WO2009075886, SEQ ID NOs: 1-5, and 7-645 in International Patent Publication No. WO2012009644, SEQ ID NO: 1 in International Patent Publication No. WO1999024595, SEQ ID NO: 1 in U.S. Pat. No. 6,310,197, and SEQ ID NO: 1 in U.S. Pat. No. 6,849,405, each of which is herein incorporated by reference in its entirety.

In yet another non-limiting example, the TEE may be an internal ribosome entry site (IRES), HCV-IRES or an IRES element such as, but not limited to, those described in U.S. Pat. No. 7,468,275, US Patent Publication Nos. US20070048776 and US20110124100 and International Patent Publication Nos. WO2007025008 and WO2001055369, each of which is herein incorporated by reference in its entirety. The IRES elements may include, but are not limited to, the Gtx sequences (e.g., Gtx9-nt, Gtx8-nt, Gtx7-nt) described by Chappell et al. (Proc. Natl. Acad. Sci. USA 101:9590-9594, 2004) and Zhou et al. (PNAS 102: 6273-6278, 2005) and in US Patent Publication Nos. US20070048776 and US20110124100 and International Patent Publication No. WO2007025008, each of which is herein incorporated by reference in its entirety.

"Translational enhancer polynucleotides" or "translation enhancer polynucleotide sequences" are polynucleotides which include one or more of the specific TEE exemplified herein and/or disclosed in the art (see e.g., U.S. Pat. No. 6,310,197, U.S. Pat. No. 6,849,405, U.S. Pat. No. 7,456,273, U.S. Pat. No. 7,183,395, US20090226470, US20070048776, US20110124100, US20090093049, US20130177581, WO2009075886, WO2007025008, WO2012009644, WO2001055371 WO1999024595, and EP2610341A1 and EP2610340A1; each of which is herein incorporated by reference in its entirety) or their variants, homologs or functional derivatives. One or multiple copies of a specific TEE can be present in the polynucleotides, primary constructs, modified nucleic acids and/or mmRNA. The TEEs in the translational enhancer polynucleotides can be organized in one or more sequence segments. A sequence segment can harbor one or more of the specific TEEs exemplified herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the specific TEEs exemplified herein, identical or different number of copies of each of the specific TEEs, and/or identical or different organization of the TEEs within each sequence segment.

In one embodiment, the polynucleotides, primary constructs, modified nucleic acids and/or mmRNA may include at least one TEE that is described in International Patent Publication No. WO1999024595, WO2012009644, WO2009075886, WO2007025008, WO1999024595, European Patent Publication No. EP2610341A1 and EP2610340A1, U.S. Pat. No. 6,310,197, U.S. Pat. No. 6,849,405, U.S. Pat. No. 7,456,273, U.S. Pat. No. 7,183,395, US Patent Publication No. US20090226470, US20110124100, US20070048776, US20090093049, and US20130177581 each of which is herein incorporated by reference in its entirety. The TEE may be located in the 5'UTR of the polynucleotides, primary constructs, modified nucleic acids and/or mmRNA.

In another embodiment, the polynucleotides, primary constructs, modified nucleic acids and/or mmRNA may include at least one TEE that has at least 50%, at least 55%, at least 60%, at least 65%, at least 70%, at least 75%, at least 80%, at least 85%, at least 90%, at least 95% or at least 99% identity with the TEEs described in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. No. 6,310,197, U.S. Pat. No. 6,849,405, U.S. Pat. No. 7,456,273, U.S. Pat. No. 7,183,395, each of which is herein incorporated by reference in its entirety.

In one embodiment, the 5'UTR of the polynucleotides, primary constructs, modified nucleic acids and/or mmRNA may include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. The TEE sequences in the 5'UTR of the polynucleotides, primary constructs, modified nucleic acids and/or mmRNA of the present invention may be the same or different TEE sequences. The TEE sequences may be in a pattern such as ABABAB or AABBAABBAABB or ABCABCABC or variants thereof repeated once, twice, or more than three times. In these patterns, each letter, A, B, or C represent a different TEE sequence at the nucleotide level.

In one embodiment, the 5'UTR may include a spacer to separate two TEE sequences. As a non-limiting example, the spacer may be a 15 nucleotide spacer and/or other spacers known in the art. As another non-limiting example, the 5'UTR may include a TEE sequence-spacer module repeated at least once, at least twice, at least 3 times, at least 4 times, at least 5 times, at least 6 times, at least 7 times, at least 8 times and at least 9 times or more than 9 times in the 5'UTR.

In another embodiment, the spacer separating two TEE sequences may include other sequences known in the art which may regulate the translation of the polynucleotides, primary constructs, modified nucleic acids and/or mmRNA of the present invention such as, but not limited to, miR sequences described herein (e.g., miR binding sites and miR seeds). As a non-limiting example, each spacer used to separate two TEE sequences may include a different miR sequence or component of a miR sequence (e.g., miR seed sequence).

In one embodiment, the TEE in the 5'UTR of the polynucleotides, primary constructs, modified nucleic acids and/or mmRNA of the present invention may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. No. 6,310,197, U.S. Pat. No. 6,849,405, U.S. Pat. No. 7,456,273, U.S. Pat. No. 7,183,395. In another embodiment, the TEE in the 5'UTR of the polynucleotides, primary constructs, modified nucleic acids and/or mmRNA of the present invention may include a 5-30 nucleotide fragment, a 5-25 nucleotide fragment, a 5-20 nucleotide fragment, a 5-15 nucleotide fragment, a 5-10 nucleotide fragment of the TEE sequences disclosed in US Patent Publication Nos. US20090226470, US20070048776, US20130177581 and US20110124100, International Patent Publication No. WO1999024595, WO2012009644, WO2009075886 and WO2007025008, European Patent Publication No. EP2610341A1 and EP2610340A1, U.S. Pat. No. 6,310,197, U.S. Pat. No. 6,849,405, U.S. Pat. No. 7,456,273, U.S. Pat. No. 7,183,395; each of which are herein incorporated by reference in their entirety.

In one embodiment, the TEE in the 5'UTR of the polynucleotides, primary constructs, modified nucleic acids and/or mmRNA of the present invention may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Chappell et al. (Proc. Natl. Acad. Sci. USA 101:9590-9594, 2004) and Zhou et al. (PNAS 102:6273-6278, 2005), in Supplemental Table 1 and in Supplemental Table 2 disclosed by Wellensiek et al (Genome-wide profiling of human cap-independent translation-enhancing elements, Nature Methods, 2013; DOI:10.1038/NMETH.2522); each of which is herein incorporated by reference in its entirety. In another embodiment, the TEE in the 5'UTR of the polynucleotides, primary constructs, modified nucleic acids and/or mmRNA of the present invention may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Chappell et al. (Proc. Natl. Acad. Sci. USA 101:9590-9594, 2004) and Zhou et al. (PNAS 102:6273-6278, 2005), in Supplemental Table 1 and in Supplemental Table 2 disclosed by Wellensiek et al (Genome-wide profiling of human cap-independent translation-enhancing elements, Nature Methods, 2013; DOI:10.1038/NMETH.2522); each of which is herein incorporated by reference in its entirety.

In one embodiment, the TEE used in the 5'UTR of the polynucleotides, primary constructs, modified nucleic acids and/or mmRNA of the present invention is an IRES sequence such as, but not limited to, those described in U.S. Pat. No. 7,468,275 and International Patent Publication No. WO2001055369, each of which is herein incorporated by reference in its entirety.

In one embodiment, the TEEs used in the 5'UTR of the polynucleotides, primary constructs, modified nucleic acids and/or mmRNA of the present invention may be identified by the methods described in US Patent Publication No. US20070048776 and US20110124100 and International Patent Publication Nos. WO2007025008 and WO2012009644, each of which is herein incorporated by reference in its entirety.

In another embodiment, the TEEs used in the 5'UTR of the polynucleotides, primary constructs, modified nucleic acids and/or mmRNA of the present invention may be a transcription regulatory element described in U.S. Pat. No. 7,456,273 and U.S. Pat. No. 7,183,395, US Patent Publication No. US20090093049, and International Publication No. WO2001055371, each of which is herein incorporated by reference in their entirety. The transcription regulatory elements may be identified by methods known in the art, such as, but not limited to, the methods described in U.S. Pat. No. 7,456,273 and U.S. Pat. No. 7,183,395, US Patent Publication No. US20090093049, and International Publication No. WO2001055371, each of which is herein incorporated by reference in their entirety.

In yet another embodiment, the TEE used in the 5'UTR of the polynucleotides, primary constructs, modified nucleic acids and/or mmRNA of the present invention is an oligonucleotide or portion thereof as described in U.S. Pat. No. 7,456,273 and U.S. Pat. No. 7,183,395, US Patent Publication No. US20090093049, and International Publication No. WO2001055371, each of which is herein incorporated by reference in their entirety.

The 5' UTR comprising at least one TEE described herein may be incorporated in a monocistronic sequence such as, but not limited to, a vector system or a nucleic acid vector. As a non-limiting example, the vector systems and nucleic acid vectors may include those described in U.S. Pat. No. 7,456,273 and U.S. Pat. No. 7,183,395, US Patent Publication No. US20070048776, US20090093049 and US20110124100 and International Patent Publication Nos. WO2007025008 and WO2001055371, each of which is herein incorporated by reference in its entirety.

In one embodiment, the TEEs described herein may be located in the 5'UTR and/or the 3'UTR of the polynucleotides, primary constructs, modified nucleic acids and/or mmRNA. The TEEs located in the 3'UTR may be the same and/or different than the TEEs located in and/or described for incorporation in the 5'UTR.

In one embodiment, the 3'UTR of the polynucleotides, primary constructs, modified nucleic acids and/or mmRNA may include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. The TEE sequences in the 3'UTR of the polynucleotides, primary constructs, modified nucleic acids and/or mmRNA of the present invention may be the same or different TEE sequences. The TEE sequences may be in a pattern such as ABABAB or AABBAABBAABB or ABCABCABC or variants thereof repeated once, twice, or more than three times. In these patterns, each letter, A, B, or C represent a different TEE sequence at the nucleotide level.

In one embodiment, the 3'UTR may include a spacer to separate two TEE sequences. As a non-limiting example, the spacer may be a 15 nucleotide spacer and/or other spacers known in the art. As another non-limiting example, the 3'UTR may include a TEE sequence-spacer module repeated at least once, at least twice, at least 3 times, at least 4 times, at least 5 times, at least 6 times, at least 7 times, at least 8 times and at least 9 times or more than 9 times in the 3'UTR.

In another embodiment, the spacer separating two TEE sequences may include other sequences known in the art which may regulate the translation of the polynucleotides, primary constructs, modified nucleic acids and/or mmRNA of the present invention such as, but not limited to, miR sequences described herein (e.g., miR binding sites and miR seeds). As a non-limiting example, each spacer used to separate two TEE sequences may include a different miR sequence or component of a miR sequence (e.g., miR seed sequence).

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

Heterologous 5'UTRs

A 5' UTR may be provided as a flanking region to the modified nucleic acids (mRNA), enhanced modified RNA or ribonucleic acids of the invention. 5'UTR may be homologous or heterologous to the coding region found in the modified nucleic acids (mRNA), enhanced modified RNA or ribonucleic acids of the invention. Multiple 5' UTRs may be included in the flanking region and may be the same or of different sequences. Any portion of the flanking regions, including none, may be codon optimized and any may independently contain one or more different structural or chemical modifications, before and/or after codon optimization.

Shown in Lengthy Table 21 in U.S. Provisional Application No. 61/775,509, filed Mar. 9, 2013, entitled Heterologous Untranslated Regions for mRNA and in Lengthy Table 21 and in Table 22 in U.S. Provisional Application No. 61/829,372, filed May 31, 2013, entitled Heterologous Untranslated Regions for mRNA, the contents of each of which is herein incorporated by reference in its entirety, is a listing of the start and stop site of the modified nucleic acids (mRNA), enhanced modified RNA or ribonucleic acids of the invention. In Table 21 each 5'UTR (5'UTR-005 to 5'UTR 68511) is identified by its start and stop site relative to its native or wild type (homologous) transcript (ENST; the identifier used in the ENSEMBL database).

Additional 5'UTR which may be used with the modified nucleic acids, enhanced modified RNA or ribonucleic acids of the invention are shown in the present disclosure in Table 6, Table 38 and Table 41.

To alter one or more properties of the polynucleotides, primary constructs or mmRNA of the invention, 5'UTRs which are heterologous to the coding region of the modified nucleic acids (mRNA), enhanced modified RNA or ribonucleic acids of the invention are engineered into compounds of the invention. The modified nucleic acids (mRNA), enhanced modified RNA or ribonucleic acids are then administered to cells, tissue or organisms and outcomes such as protein level, localization and/or half life are measured to evaluate the beneficial effects the heterologous 5'UTR may have on the modified nucleic acids (mRNA), enhanced modified RNA or ribonucleic acids of the invention. Variants of the 5' UTRs may be utilized wherein one or more nucleotides are added or removed to the termini, including A, T, C or G. 5'UTRs may also be codon-optimized or modified in any manner described herein.

Incorporating microRNA Binding Sites

In one embodiment modified nucleic acids (mRNA), enhanced modified RNA or ribonucleic acids of the invention would not only encode a polypeptide but also a sensor sequence. Sensor sequences include, for example, microRNA binding sites, transcription factor binding sites, structured mRNA sequences and/or motifs, artificial binding sites engineered to act as pseudo-receptors for endogenous nucleic acid binding molecules. Non-limiting examples, of polynucleotides comprising at least one sensor sequence are described in co-pending and co-owned U.S. Provisional Patent Application No. 61/753,661, filed Jan. 17, 2013, entitled Signal-Sensor Polynucleotide for the Alteration of Cellular Phenotypes and Microenvironments, U.S. Provisional Patent Application No. 61/754,159, filed Jan. 18, 2013, entitled Signal-Sensor Polynucleotide for the Alteration of Cellular Phenotypes and Microenvironments, U.S. Provisional Patent Application No. 61/781,097, filed Mar.

14, 2013, entitled Signal-Sensor Polynucleotide for the Alteration of Cellular Phenotypes and Microenvironments, U.S. Provisional Patent Application No. 61/829,334, filed May 31, 2013, entitled Signal-Sensor Polynucleotide for the Alteration of Cellular Phenotypes and Microenvironments, U.S. Provisional Patent Application No. 61/839,893, filed Jun. 27, 2013, entitled Signal-Sensor Polynucleotide for the Alteration of Cellular Phenotypes and Microenvironments, U.S. Provisional Patent Application No. 61/842,733, filed Jul. 3, 2013, entitled Signal-Sensor Polynucleotide for the Alteration of Cellular Phenotypes and Microenvironment, and U.S. Provisional Patent Application No. 61/857,304, filed Jul. 23, 2013, entitled Signal-Sensor Polynucleotide for the Alteration of Cellular Phenotypes and Microenvironment, the contents of each of which are herein incorporated by reference in its entirety.

In one embodiment, microRNA (miRNA) profiling of the target cells or tissues is conducted to determine the presence or absence of miRNA in the cells or tissues.

microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The modified nucleic acids (mRNA), enhanced modified RNA or ribonucleic acids of the invention may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety. As a non-limiting embodiment, known microRNAs, their sequences and seed sequences in human genome are listed below in Table 11.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105. The bases of the microRNA seed have complete complementarity with the target sequence. By engineering microRNA target sequences into the 3'UTR of nucleic acids or mRNA of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; Gentner and Naldini, Tissue Antigens. 2012 80:393-403 and all references therein; each of which is herein incorporated by reference in its entirety).

For example, if the mRNA is not intended to be delivered to the liver but ends up there, then miR-122, a microRNA abundant in liver, can inhibit the expression of the gene of interest if one or multiple target sites of miR-122 are engineered into the 3'UTR of the modified nucleic acids, enhanced modified RNA or ribonucleic acids. Introduction of one or multiple binding sites for different microRNA can be engineered to further decrease the longevity, stability, and protein translation of a modified nucleic acids, enhanced modified RNA or ribonucleic acids. As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the modified nucleic acids, enhanced modified RNA or ribonucleic acids of the present invention, microRNA binding sites can be engineered out of (i.e. removed from) sequences in which they naturally occur in order to increase protein expression in specific tissues. For example, miR-122 binding sites may be removed to improve protein expression in the liver.

In one embodiment, the modified nucleic acids, enhanced modified RNA or ribonucleic acids of the present invention may include at least one miRNA-binding site in the 3'UTR in order to direct cytotoxic or cytoprotective mRNA therapeutics to specific cells such as, but not limited to, normal and/or cancerous cells (e.g., HEP3B or SNU449).

In another embodiment, the modified nucleic acids, enhanced modified RNA or ribonucleic acids of the present invention may include three miRNA-binding sites in the 3'UTR in order to direct cytotoxic or cytoprotective mRNA therapeutics to specific cells such as, but not limited to, normal and/or cancerous cells (e.g., HEP3B or SNU449).

Regulation of expression in multiple tissues can be accomplished through introduction or removal or one or several microRNA binding sites. Shown below in Table 12, microRNAs which are differentially expressed in different tissues and cells, and often associated with different types of diseases (e.g. cancer cells). The decision of removal or insertion of microRNA binding sites, or any combination, is dependent on microRNA expression patterns and their profilings in diseases.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126).

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granuocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. It was demonstrated in the art that the immune response to exogenous nucleic acid molecules was shut-off by adding miR-142 binding sites to the 3'UTR of the delivered gene construct, enabling more stable gene transfer in tissues and cells. miR-142 efficiently degrades the exogenous mRNA in antigen presenting cells and suppresses cytotoxic elimination of transduced cells (Annoni A et al., blood, 2009, 114, 5152-5161; Brown B D, et al., Nat med. 2006, 12(5), 585-591; Brown B D, et al., blood, 2007, 110(13): 4144-4152, each of which is herein incorporated by reference in its entirety).

An antigen-mediated immune response can refer to an immune response triggered by foreign antigens, which, when entering an organism, are processed by the antigen presenting cells and displayed on the surface of the antigen presenting cells. T cells can recognize the presented antigen and induce a cytotoxic elimination of cells that express the antigen.

Introducing the miR-142 binding site into the 3'-UTR of a polypeptide of the present invention can selectively repress the gene expression in the antigen presenting cells through miR-142 mediated mRNA degradation, limiting antigen presentation in APCs (e.g. dendritic cells) and thereby preventing antigen-mediated immune response after the delivery of the polynucleotides. The polynucleotides are therefore stably expressed in target tissues or cells without triggering cytotoxic elimination.

In one embodiment, microRNAs binding sites that are known to be expressed in immune cells, in particular, the antigen presenting cells, can be engineered into the polynucleotide to suppress the expression of the sensor-signal polynucleotide in APCs through microRNA mediated RNA degradation, subduing the antigen-mediated immune response, while the expression of the polynucleotide is maintained in non-immune cells where the immune cell specific microRNAs are not expressed. For example, to prevent the immunogenic reaction caused by a liver specific protein expression, the miR-122 binding site can be removed and the miR-142 (and/or mirR-146) binding sites can be engineered into the 3-UTR of the polynucleotide.

To further drive the selective degradation and suppression of mRNA in APCs and macrophage, the polynucleotide may include another negative regulatory element in the 3-UTR, either alone or in combination with mir-142 and/or mir-146 binding sites. As a non-limiting example, one regulatory element is the Constitutive Decay Elements (CDEs).

Immune cells specific microRNAs include, but are not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p and miR-99b-5p. microRNAs that are enriched in specific types of immune cells are listed in Table 13. Furthermore, novel microRNAs are discovered in the immune cells in the art through micro-array hybridization and microtome analysis (Jima D D et al, Blood, 2010, 116:e118-e127; Vaz C et al., BMC Genomics, 2010, 11,288, the content of each of which is incorporated herein by reference in its entirety.)

MicroRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, miR-939-5p. MicroRNA binding sites from any liver specific microRNA can be introduced to or removed from the polynucleotides to regulate the expression of the polynucleotides in the liver. Liver specific microRNAs binding sites can be engineered alone or further in combination with immune cells (e.g. APCs) microRNA binding sites in order to prevent immune reaction against protein expression in the liver.

MicroRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, miR-381-5p. MicroRNA binding sites from any lung specific microRNA can be introduced to or removed from the polynucleotide to regulate the expression of the polynucleotide in the lung. Lung specific microRNAs binding sites can be engineered alone or further in combination with immune cells (e.g. APCs) microRNA binding sites in order to prevent an immune reaction against protein expression in the lung.

MicroRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p and miR-92b-5p. MicroRNA binding sites from any heart specific microRNA can be introduced to or removed from the polynucleotides to regulate the expression of the polynucleotides in the heart. Heart specific microRNAs binding sites can be engineered alone or further in combination with immune cells (e.g. APCs) microRNA binding sites to prevent an immune reaction against protein expression in the heart.

MicroRNAs that are known to be expressed in the nervous system include, but are not limited to, miR-124-5p, miR-125a-3p, miR-125a-5p, miR-125b-1-3p, miR-125b-2-3p, miR-125b-5p, miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-

3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-3p and miR-9-5p. MicroRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, miR-657. MicroRNA binding sites from any CNS specific microRNA can be introduced to or removed from the polynucleotides to regulate the expression of the polynucleotide in the nervous system. Nervous system specific microRNAs binding sites can be engineered alone or further in combination with immune cells (e.g. APCs) microRNA binding sites in order to prevent immune reaction against protein expression in the nervous system.

MicroRNAs that are known to be expressed in the pancreas include, but are not limited to, miR-105-3p, miR-105-5p, miR-184, miR-195-3p, miR-195-5p, miR-196a-3p, miR-196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p and miR-944. MicroRNA binding sites from any pancreas specific microRNA can be introduced to or removed from the polynucleotide to regulate the expression of the polynucleotide in the pancreas. Pancreas specific microRNAs binding sites can be engineered alone or further in combination with immune cells (e.g. APCs) microRNA binding sites in order to prevent an immune reaction against protein expression in the pancreas.

MicroRNAs that are known to be expressed in the kidney further include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR-30c-1-3p, miR-30c-2-3p, miR30c-5p, miR-324-3p, miR-335-3p, miR-335-5p, miR-363-3p, miR-363-5p and miR-562. MicroRNA binding sites from any kidney specific microRNA can be introduced to or removed from the polynucleotide to regulate the expression of the polynucleotide in the kidney. Kidney specific microRNAs binding sites can be engineered alone or further in combination with immune cells (e.g. APCs) microRNA binding sites to prevent an immune reaction against protein expression in the kidney.

MicroRNAs that are known to be expressed in the muscle further include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p and miR-25-5p. MicroRNA binding sites from any muscle specific microRNA can be introduced to or removed from the polynucleotide to regulate the expression of the polynucleotide in the muscle. Muscle specific microRNAs binding sites can be engineered alone or further in combination with immune cells (e.g. APCs) microRNA binding sites to prevent an immune reaction against protein expression in the muscle.

MicroRNAs are differentially expressed in different types of cells, such as endothelial cells, epithelial cells and adipocytes. For example, microRNAs that are expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p and miR-92b-5p. Many novel microRNAs are discovered in endothelial cells from deep-sequencing analysis (Voellenkle C et al., RNA, 2012, 18, 472-484, herein incorporated by reference in its entirety) microRNA binding sites from any endothelial cell specific microRNA can be introduced to or removed from the polynucleotide to modulate the expression of the polynucleotide in the endothelial cells in various conditions.

For further example, microRNAs that are expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells; let-7 family, miR-133a, miR-133b, miR-126 specific in lung epithelial cells; miR-382-3p, miR-382-5p specific in renal epithelial cells and miR-762 specific in corneal epithelial cells. MicroRNA binding sites from any epithelial cell specific MicroRNA can be introduced to or removed from the polynucleotide to modulate the expression of the polynucleotide in the epithelial cells in various conditions.

In addition, a large group of microRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res, 2008, 18, 610-621; Yoo J K et al., Stem Cells Dev. 2012, 21(11), 2049-2057, each of which is herein incorporated by reference in its entirety). MicroRNAs abundant in embryonic stem cells include, but are not limited to, let-7a-2-3p, let-a-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-548l, miR-548m, miR-548n, miR-548o-3p, miR-548o-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-

5p, miR-99b-3p and miR-99b-5p. Many predicted novel microRNAs are discovered by deep sequencing in human embryonic stem cells (Morin R D et al., Genome Res, 2008, 18, 610-621; Goff L A et al., PLoS One, 2009, 4:e7192; Bar M et al., Stem cells, 2008, 26, 2496-2505, the content of each of which is incorporated herein by references in its entirety).

In one embodiment, the binding sites of embryonic stem cell specific microRNAs can be included in or removed from the 3-UTR of the polynucleotide to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cells).

Many microRNA expression studies are conducted in the art to profile the differential expression of microRNAs in various cancer cells/tissues and other diseases. Some microRNAs are abnormally over-expressed in certain cancer cells and others are under-expressed. For example, microRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T cell lymphoma (WO2013/011378); colorectal cancer cells (WO2011/0281756, WO2011/076142); cancer positive lympho nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563, the content of each of which is incorporated herein by reference in their entirety.)

As a non-limiting example, microRNA sites that are over-expressed in certain cancer and/or tumor cells can be removed from the 3-UTR of the polynucleotide encoding the polypeptide of interest, restoring the expression suppressed by the over-expressed microRNAs in cancer cells, thus ameliorating the corresponsive biological function, for instance, transcription stimulation and/or repression, cell cycle arrest, apoptosis and cell death. Normal cells and tissues, wherein microRNAs expression is not up-regulated, will remain unaffected.

MicroRNA can also regulate complex biological processes such as angiogenesis (miR-132) (Anand and Cheresh Curr Opin Hematol 2011 18:171-176). In the modified nucleic acids, enhanced modified RNA or ribonucleic acids of the invention, binding sites for microRNAs that are involved in such processes may be removed or introduced, in order to tailor the expression of the modified nucleic acids, enhanced modified RNA or ribonucleic acids expression to biologically relevant cell types or to the context of relevant biological processes. In this context, the mRNA are defined as auxotrophic mRNA.

MicroRNA gene regulation may be influenced by the sequence surrounding the microRNA such as, but not limited to, the species of the surrounding sequence, the type of sequence (e.g., heterologous, homologous and artificial), regulatory elements in the surrounding sequence and/or structural elements in the surrounding sequence. The microRNA may be influenced by the 5'UTR and/or the 3'UTR. As a non-limiting example, a non-human 3'UTR may increase the regulatory effect of the microRNA sequence on the expression of a polypeptide of interest compared to a human 3'UTR of the same sequence type.

In one embodiment, other regulatory elements and/or structural elements of the 5'-UTR can influence microRNA mediated gene regulation. One example of a regulatory element and/or structural element is a structured IRES (Internal Ribosome Entry Site) in the 5'UTR, which is necessary for the binding of translational elongation factors to initiate protein translation. EIF4A2 binding to this secondarily structured element in the 5'UTR is necessary for microRNA mediated gene expression (Meijer H A et al., Science, 2013, 340, 82-85, herein incorporated by reference in its entirety). The modified nucleic acids, enhanced modified RNA or ribonucleic acids of the invention can further be modified to include this structured 5'-UTR in order to enhance microRNA mediated gene regulation.

At least one microRNA site can be engineered into the 3' UTR of the modified nucleic acids, enhanced modified RNA or ribonucleic acids of the present invention. In this context, at least two, at least three, at least four, at least five, at least six, at least seven, at least eight, at least nine, at least ten or more microRNA sites may be engineered into the 3' UTR of the ribonucleic acids of the present invention. In one embodiment, the microRNA sites incorporated into the modified nucleic acids, enhanced modified RNA or ribonucleic acids may be the same or may be different microRNA sites. In another embodiment, the microRNA sites incorporated into the modified nucleic acids, enhanced modified RNA or ribonucleic acids may target the same or different tissues in the body. As a non-limiting example, through the introduction of tissue-, cell-type-, or disease-specific microRNA binding sites in the 3' UTR of a modified nucleic acid mRNA, the degree of expression in specific cell types (e.g. hepatocytes, myeloid cells, endothelial cells, cancer cells, etc.) can be reduced.

In one embodiment, a microRNA site can be engineered near the 5' terminus of the 3'UTR, about halfway between the 5' terminus and 3' terminus of the 3'UTR and/or near the 3' terminus of the 3'UTR. As a non-limiting example, a microRNA site may be engineered near the 5' terminus of the 3'UTR and about halfway between the 5' terminus and 3' terminus of the 3'UTR. As another non-limiting example, a microRNA site may be engineered near the 3' terminus of the 3'UTR and about halfway between the 5' terminus and 3' terminus of the 3'UTR. As yet another non-limiting example, a microRNA site may be engineered near the 5' terminus of the 3'UTR and near the 3' terminus of the 3'UTR.

In another embodiment, a 3'UTR can comprise 4 microRNA sites. The microRNA sites may be complete microRNA binding sites, microRNA seed sequences and/or microRNA binding site sequences without the seed sequence.

In one embodiment, a nucleic acid of the invention may be engineered to include at least one microRNA in order to dampen the antigen presentation by antigen presenting cells. The microRNA may be the complete microRNA sequence, the microRNA seed sequence, the microRNA sequence without the seed or a combination thereof. As a non-limiting example, the microRNA incorporated into the nucleic acid may be specific to the hematopoietic system. As another non-limiting example, the microRNA incorporated into the nucleic acid of the invention to dampen antigen presentation is miR-142-3p.

In one embodiment, a nucleic acid may be engineered to include microRNA sites which are expressed in different tissues of a subject. As a non-limiting example, a modified nucleic acid, enhanced modified RNA or ribonucleic acid of the present invention may be engineered to include miR-192 and miR-122 to regulate expression of the modified nucleic acid, enhanced modified RNA or ribonucleic acid in the liver and kidneys of a subject. In another embodiment, a modified nucleic acid, enhanced modified RNA or ribonucleic acid may be engineered to include more than one microRNA sites for the same tissue. For example, a modified nucleic acid, enhanced modified RNA or ribonucleic acid of the present invention may be engineered to include miR-17-92 and miR-126 to regulate expression of the modified nucleic acid, enhanced modified RNA or ribonucleic acid in endothelial cells of a subject.

In one embodiment, the therapeutic window and or differential expression associated with the target polypeptide encoded by the modified nucleic acid, enhanced modified RNA or ribonucleic acid encoding a signal (also referred to herein as a polynucleotide) of the invention may be altered. For example, polynucleotides may be designed whereby a death signal is more highly expressed in cancer cells (or a survival signal in a normal cell) by virtue of the miRNA signature of those cells. Where a cancer cell expresses a lower level of a particular miRNA, the polynucleotide encoding the binding site for that miRNA (or miRNAs) would be more highly expressed. Hence, the target polypeptide encoded by the polynucleotide is selected as a protein which triggers or induces cell death. Neighboring noncancer cells, harboring a higher expression of the same miRNA would be less affected by the encoded death signal as the polynucleotide would be expressed at a lower level due to the affects of the miRNA binding to the binding site or "sensor" encoded in the 3'UTR. Conversely, cell survival or cytoprotective signals may be delivered to tissues containing cancer and non cancerous cells where a miRNA has a higher expression in the cancer cells—the result being a lower survival signal to the cancer cell and a larger survival signature to the normal cell. Multiple polynucleotides may be designed and administered having different signals according to the previous paradigm.

In one embodiment, the expression of a nucleic acid may be controlled by incorporating at least one sensor sequence in the nucleic acid and formulating the nucleic acid. As a non-limiting example, a nucleic acid may be targeted to an orthotopic tumor by having a nucleic acid incorporating a miR-122 binding site and formulated in a lipid nanoparticle comprising the cationic lipid DLin-KC2-DMA (see e.g., the experiments described in Example 49A and 49B).

According to the present invention, the polynucleotides may be modified as to avoid the deficiencies of other polypeptide-encoding molecules of the art. Hence, in this embodiment the polynucleotides are referred to as modified polynucleotides.

Through an understanding of the expression patterns of microRNA in different cell types, modified nucleic acids, enhanced modified RNA or ribonucleic acids such as polynucleotides can be engineered for more targeted expression in specific cell types or only under specific biological conditions. Through introduction of tissue-specific microRNA binding sites, modified nucleic acids, enhanced modified RNA or ribonucleic acids, could be designed that would be optimal for protein expression in a tissue or in the context of a biological condition.

Transfection experiments can be conducted in relevant cell lines, using engineered modified nucleic acids, enhanced modified RNA or ribonucleic acids and protein production can be assayed at various time points post-transfection. For example, cells can be transfected with different microRNA binding site-engineering nucleic acids or mRNA and by using an ELISA kit to the relevant protein and assaying protein produced at 6 hr, 12 hr, 24 hr, 48 hr, 72 hr and 7 days post-transfection. In vivo experiments can also be conducted using microRNA-binding site-engineered molecules to examine changes in tissue-specific expression of formulated modified nucleic acids, enhanced modified RNA or ribonucleic acids.

Non-limiting examples of cell lines which may be useful in these investigations include those from ATCC (Manassas, Va.) including MRC-5, A549, T84, NCI-H2126 [H2126], NCI-H1688 [H1688], WI-38, WI-38 VA-13 subline 2RA, WI-26 VA4, C3A [HepG2/C3A, derivative of Hep G2 (ATCC HB-8065)], THLE-3, H69AR, NCI-H292 [H292], CFPAC-1, NTERA-2 cl.D1 [NT2/D1], DMS 79, DMS 53, DMS 153, DMS 114, MSTO-211H, SW 1573 [SW-1573, SW1573], SW 1271 [SW-1271, SW1271], SHP-77, SNU-398, SNU-449, SNU-182, SNU-475, SNU-387, SNU-423, NL20, NL20-TA [NL20T-A], THLE-2, HBE135-E6E7, HCC827, HCC4006, NCI-H23 [H23], NCI-H1299, NCI-H187 [H187], NCI-H358 [H-358, H358], NCI-H378 [H378], NCI-H522 [H522], NCI-H526 [H526], NCI-H727 [H727], NCI-H810 [H810], NCI-H889 [H889], NCI-H1155 [H1155], NCI-H1404 [H1404], NCI-N87 [N87], NCI-H196 [H196], NCI-H211 [H211], NCI-H220 [H220], NCI-H250 [H250], NCI-H524 [H524], NCI-H647 [H647], NCI-H650 [H650], NCI-H711 [H711], NCI-H719 [H719], NCI-H740 [H740], NCI-H748 [H748], NCI-H774 [H774], NCI-H838 [H838], NCI-H841 [H841], NCI-H847 [H847], NCI-H865 [H865], NCI-H920 [H920], NCI-H1048 [H1048], NCI-H1092 [H1092], NCI-H1105 [H1105], NCI-H1184 [H1184], NCI-H1238 [H1238], NCI-H1341 [H1341], NCI-H1385 [H1385], NCI-H1417 [H1417], NCI-H1435 [H1435], NCI-H1436 [H1436], NCI-H1437 [H1437], NCI-H1522 [H1522], NCI-H1563 [H1563], NCI-H1568 [H1568], NCI-H1573 [H1573], NCI-H1581 [H1581], NCI-H1618 [H1618], NCI-H1623 [H1623], NCI-H1650 [H-1650, H1650], NCI-H1651 [H1651], NCI-H1666 [H-1666, H1666], NCI-H1672 [H1672], NCI-H1693 [H1693], NCI-H1694 [H1694], NCI-H1703 [H1703], NCI-H1734 [H-1734, H1734], NCI-H1755 [H1755], NCI-H1755 [H1755], NCI-H1770 [H1770], NCI-H1793 [H1793], NCI-H1836 [H1836], NCI-H1838 [H1838], NCI-H1869 [H1869], NCI-H1876 [H1876], NCI-H1882 [H1882], NCI-H1915 [H1915], NCI-H1930 [H1930], NCI-H1944 [H1944], NCI-H1975 [H-1975, H1975], NCI-H1993 [H1993], NCI-H2023 [H2023], NCI-H2029 [H2029], NCI-H2030 [H2030], NCI-H2066 [H2066], NCI-H2073 [H2073], NCI-H2081 [H2081], NCI-H2085 [H2085], NCI-H2087 [H2087], NCI-H2106 [H2106], NCI-H2110 [H2110], NCI-H2135 [H2135], NCI-H2141 [H2141], NCI-H2171 [H2171], NCI-H2172 [H2172], NCI-H2195 [H2195], NCI-H2196 [H2196], NCI-H2198 [H2198], NCI-H2227 [H2227], NCI-H2228 [H2228], NCI-H2286 [H2286], NCI-H2291 [H2291], NCI-H2330 [H2330], NCI-H2342 [H2342], NCI-H2347 [H2347], NCI-H2405 [H2405], NCI-H2444 [H2444], UMC-11, NCI-H64 [H64], NCI-H735 [H735], NCI-H735 [H735], NCI-H1963 [H1963], NCI-H2107 [H2107], NCI-H2108 [H2108], NCI-H2122 [H2122], Hs 573.T, Hs 573.Lu, PLC/PRF/5, BEAS-2B, Hep G2, Tera-1, Tera-2, NCI-H69 [H69], NCI-H128 [H128], ChaGo-K-1, NCI-H446 [H446], NCI-H209 [H209], NCI-H146 [H146], NCI-H441 [H441], NCI-H82 [H82], NCI-H460 [H460], NCI-H596 [H596], NCI-H676B

[H676B], NCI-H345 [H345], NCI-H820 [H820], NCI-H520 [H520], NCI-H661 [H661], NCI-H510A [H510A, NCI-H510], SK-HEP-1, A-427, Calu-1, Calu-3, Calu-6, SK-LU-1, SK-MES-1, SW 900 [SW-900, SW900], Malme-3M, and Capan-1.

In some embodiments, modified messenger RNA can be designed to incorporate microRNA binding region sites that either have 100% identity to known seed sequences or have less than 100% identity to seed sequences. The seed sequence can be partially mutated to decrease microRNA binding affinity and as such result in reduced downmodulation of that mRNA transcript. In essence, the degree of match or mis-match between the target mRNA and the microRNA seed can act as a rheostat to more finely tune the ability of the microRNA to modulate protein expression. In addition, mutation in the non-seed region of a microRNA binding site may also impact the ability of a microRNA to modulate protein expression.

In one embodiment, a miR sequence may be incorporated into the loop of a stem loop.

In another embodiment, a miR seed sequence may be incorporated in the loop of a stem loop and a miR binding site may be incorporated into the 5' or 3' stem of the stem loop.

In one embodiment, a TEE may be incorporated on the 5' end of the stem of a stem loop and a miR seed may be incorporated into the stem of the stem loop. In another embodiment, a TEE may be incorporated on the 5' end of the stem of a stem loop, a miR seed may be incorporated into the stem of the stem loop and a miR binding site may be incorporated into the 3' end of the stem or the sequence after the stem loop. The miR seed and the miR binding site may be for the same and/or different miR sequences.

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

In one embodiment, the 5'UTR may comprise at least one microRNA sequence. The microRNA sequence may be, but is not limited to, a 19 or 22 nucleotide sequence and/or a microRNA sequence without the seed.

In one embodiment the microRNA sequence in the 5'UTR may be used to stabilize the nucleic acid and/or mRNA described herein.

In another embodiment, a microRNA sequence in the 5'UTR may be used to decrease the accessibility of the site of translation initiation such as, but not limited to a start codon. Matsuda et al (PLoS One. 2010 11(5):e15057; herein incorporated by reference in its entirety) used antisense locked nucleic acid (LNA) oligonucleotides and exon-junction complexes (EJCs) around a start codon (−4 to +37 where the A of the AUG codons is +1) in order to decrease the accessibility to the first start codon (AUG). Matsuda showed that altering the sequence around the start codon with an LNA or EJC the efficiency, length and structural stability of the nucleic acid or mRNA is affected. The nucleic acids or mRNA of the present invention may comprise a microRNA sequence, instead of the LNA or EJC sequence described by Matsuda et al, near the site of translation initiation in order to decrease the accessibility to the site of translation initiation. The site of translation initiation may be prior to, after or within the microRNA sequence. As a non-limiting example, the site of translation initiation may be located within a microRNA sequence such as a seed sequence or binding site. As another non-limiting example, the site of translation initiation may be located within a miR-122 sequence such as the seed sequence or the mir-122 binding site.

In one embodiment, the nucleic acids or mRNA of the present invention may include at least one microRNA in order to dampen the antigen presentation by antigen presenting cells. The microRNA may be the complete microRNA sequence, the microRNA seed sequence, the microRNA sequence without the seed or a combination thereof. As a non-limiting example, the microRNA incorporated into the nucleic acids or mRNA of the present invention may be specific to the hematopoietic system. As another non-limiting example, the microRNA incorporated into the nucleic acids or mRNA of the present invention to dampen antigen presentation is miR-142-3p.

In one embodiment, the nucleic acids or mRNA of the present invention may include at least one microRNA in order to dampen expression of the encoded polypeptide in a cell of interest. As a non-limiting example, the nucleic acids or mRNA of the present invention may include at least one miR-122 binding site in order to dampen expression of an encoded polypeptide of interest in the liver. As another non-limiting example, the nucleic acids or mRNA of the present invention may include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence (see e.g., the experiment outlined in Example 24, 25, 26, 26, 36 and 48).

In one embodiment, the nucleic acids or mRNA of the present invention may comprise at least one microRNA binding site in the 3'UTR in order to selectively degrade mRNA therapeutics in the immune cells to subdue unwanted immunogenic reactions caused by therapeutic delivery. As a non-limiting example, the microRNA binding site may be the modified nucleic acids more unstable in antigen presenting cells. Non-limiting examples of these microRNA include mir-142-5p, mir-142-3p, mir-146a-5p and mir-146-3p.

In one embodiment, the nucleic acids or mRNA of the present invention comprises at least one microRNA sequence in a region of the nucleic acid or mRNA which may interact with a RNA binding protein.

RNA Motifs for RNA Binding Proteins (RBPs)

RNA binding proteins (RBPs) can regulate numerous aspects of co- and post-transcription gene expression such as, but not limited to, RNA splicing, localization, translation, turnover, polyadenylation, capping, modification, export and localization. RNA-binding domains (RBDs), such as, but not limited to, RNA recognition motif (RR) and hnRNP K-homology (KH) domains, typically regulate the sequence association between RBPs and their RNA targets (Ray et al. Nature 2013. 499:172-177; herein incorporated by reference in its entirety). In one embodiment, the canonical RBDs can bind short RNA sequences. In another embodiment, the canonical RBDs can recognize structure RNAs.

Non limiting examples of RNA binding proteins and related nucleic acid and protein sequences are shown in Table 26 in Example 23.

In one embodiment, to increase the stability of the mRNA of interest, an mRNA encoding HuR can be co-transfected or co-injected along with the mRNA of interest into the cells or into the tissue. These proteins can also be tethered to the mRNA of interest in vitro and then administered to the cells together. Poly A tail binding protein, PABP interacts with eukaryotic translation initiation factor eIF4G to stimulate translational initiation. Co-administration of mRNAs encoding these RBPs along with the mRNA drug and/or tethering these proteins to the mRNA drug in vitro and administering the protein-bound mRNA into the cells can increase the translational efficiency of the mRNA. The same concept can be extended to co-administration of mRNA along with mRNAs encoding various translation factors and facilitators as well as with the proteins themselves to influence RNA stability and/or translational efficiency.

In one embodiment, the nucleic acids and/or mRNA may comprise at least one RNA-binding motif such as, but not limited to a RNA-binding domain (RBD).

In one embodiment, the RBD may be any of the RBDs, fragments or variants thereof descried by Ray et al. (Nature 2013. 499:172-177; herein incorporated by reference in its entirety).

In one embodiment, the nucleic acids or mRNA of the present invention may comprise a sequence for at least one RNA-binding domain (RBDs). When the nucleic acids or mRNA of the present invention comprise more than one RBD, the RBDs do not need to be from the same species or even the same structural class.

In one embodiment, at least one flanking region (e.g., the 5'UTR and/or the 3'UTR) may comprise at least one RBD. In another embodiment, the first flanking region and the second flanking region may both comprise at least one RBD. The RBD may be the same or each of the RBDs may have at least 60% sequence identity to the other RBD. As a non-limiting example, at least on RBD may be located before, after and/or within the 3'UTR of the nucleic acid or mRNA of the present invention. As another non-limiting example, at least one RBD may be located before or within the first 300 nucleosides of the 3'UTR.

In another embodiment, the nucleic acids and/or mRNA of the present invention may comprise at least one RBD in the first region of linked nucleosides. The RBD may be located before, after or within a coding region (e.g., the ORF).

In yet another embodiment, the first region of linked nucleosides and/or at least one flanking region may comprise at least on RBD. As a non-limiting example, the first region of linked nucleosides may comprise a RBD related to splicing factors and at least one flanking region may comprise a RBD for stability and/or translation factors.

In one embodiment, the nucleic acids and/or mRNA of the present invention may comprise at least one RBD located in a coding and/or non-coding region of the nucleic acids and/or mRNA.

In one embodiment, at least one RBD may be incorporated into at least one flanking region to increase the stability of the nucleic acid and/or mRNA of the present invention.

In one embodiment, a microRNA sequence in a RNA binding protein motif may be used to decrease the accessibility of the site of translation initiation such as, but not limited to a start codon. The nucleic acids or mRNA of the present invention may comprise a microRNA sequence, instead of the LNA or EJC sequence described by Matsuda et al, near the site of translation initiation in order to decrease the accessibility to the site of translation initiation. The site of translation initiation may be prior to, after or within the microRNA sequence. As a non-limiting example, the site of translation initiation may be located within a microRNA sequence such as a seed sequence or binding site. As another non-limiting example, the site of translation initiation may be located within a miR-122 sequence such as the seed sequence or the mir-122 binding site.

In another embodiment, an antisense locked nucleic acid (LNA) oligonucleotides and exon-junction complexes (EJCs) may be used in the RNA binding protein motif. The LNA and EJCs may be used around a start codon (−4 to +37 where the A of the AUG codons is +1) in order to decrease the accessibility to the first start codon (AUG).

Other Regulatory Elements in 3'UTR

In addition to microRNA binding sites, other regulatory sequences in the 3'-UTR of natural mRNA, which regulate mRNA stability and translation in different tissues and cells, can be removed or introduced into modified messenger RNA. Such cis-regulatory elements may include, but are not limited to, Cis-RNP (Ribonucleoprotein)/RBP (RNA binding protein) regulatory elements, AU-rich element (AUE), structured stem-loop, constitutive decay elements (CDEs), GC-richness and other structured mRNA motifs (Parker B J et al., Genome Research, 2011, 21, 1929-1943, which is herein incorporated by reference in its entirety). For example, CDEs are a class of regulatory motifs that mediate mRNA degradation through their interaction with Roquin proteins. In particular, CDEs are found in many mRNAs that encode regulators of development and inflammation to limit cytokine production in macrophage (Leppek K et al., 2013, Cell, 153, 869-881, which is herein incorporated by reference in its entirety).

In one embodiment, a particular CDE can be introduced to the nucleic acids or mRNA when the degradation of polypeptides in a cell or tissue is desired. A particular CDE can also be removed from the nucleic acids or mRNA to maintain a more stable mRNA in a cell or tissue for sustaining protein expression.

Auxotrophic mRNA

In one embodiment, the nucleic acids or mRNA of the present invention may be auxotrophic. As used herein, the term "auxotrophic" refers to mRNA that comprises at least one feature that triggers, facilitates or induces the degradation or inactivation of the mRNA in response to spatial or temporal cues such that protein expression is substantially prevented or reduced. Such spatial or temporal cues include the location of the mRNA to be translated such as a particular tissue or organ or cellular environment. Also contemplated are cues involving temperature, pH, ionic strength, moisture content and the like.

In one embodiment, the feature is located in a terminal region of the nucleic acids or mRNA of the present invention. As a non-limiting example, the auxotrophic mRNA may contain a miR binding site in the terminal region which binds to a miR expressed in a selected tissue so that the expression of the auxotrophic mRNA is substantially prevented or reduced in the selected tissue. To this end and for example, an auxotrophic mRNA containing a miR-122 binding site will not produce protein if localized to the liver since miR-122 is expressed in the liver and binding of the miR would effectuate destruction of the auxotrophic mRNA. As a non-limiting example, HEK293 cells do not express miR-122 so there would be little to no downregulation of a nucleic acid or mRNA of the present invention having a miR-122 sequence in HEK293 but for hepatocytes which do expression miR-122 there would be a downregulation of a nucleic acid or mRNA of the present invention having a miR-122 sequence in hepatocytes (see e.g., the study outlined Example 14). As another non-limiting example, the miR-122 level can be measured in HeLa cells, primary human hepatocytes and primary rat hepatocytes prior to administration with a nucleic acid or mRNA of the present invention encoding at least one miR-122 binding site, miR-122 binding site without the seed sequence or a miR-122 binding site After administration the expression of the modified nucleic acid with a microRNA sequence can be measured to determine the dampening effect of the miR-122 in the modified nucleic acid (see e.g., the studies outlined in Examples 28, 29, 30, 35, 45, 46 and 47). As yet another non-limiting example, the effectiveness of the miR-122 binding site, miR-122 seed or the miR-122 binding site without the seed in different 3'UTRs may be evaluated in order to determine the proper UTR for the desired outcome such as, but not limited to, the highest dampening effect (see e.g., the study outlined in Example 35 and 46).

In one embodiment, the degradation or inactivation of auxotrophic mRNA may comprise a feature responsive to a change in pH. As a non-limiting example, the auxotrophic mRNA may be triggered in an environment having a pH of between pH 4.5 to 8.0 such as at a pH of 5.0 to 6.0 or a pH of 6.0 to 6.5. The change in pH may be a change of 0.1 unit, 0.2 units, 0.3 units, 0.4 units, 0.5 units, 0.6 units, 0.7 units, 0.8 units, 0.9 units, 1.0 units, 1.1 units, 1.2 units, 1.3 units, 1.4 units, 1.5 units, 1.6 units, 1.7 units, 1.8 units, 1.9 units, 2.0 units, 2.1 units, 2.2 units, 2.3 units, 2.4 units, 2.5 units, 2.6 units, 2.7 units, 2.8 units, 2.9 units, 3.0 units, 3.1 units, 3.2 units, 3.3 units, 3.4 units, 3.5 units, 3.6 units, 3.7 units, 3.8 units, 3.9 units, 4.0 units or more.

In another embodiment, the degradation or inactivation of auxotrophic mRNA may be triggered or induced by changes in temperature. As a non-limiting example, a change of temperature from room temperature to body temperature. The change of temperature may be less than 1° C., less than 5° C., less than 10° C., less than 15° C., less than 20° C., less than 25° C. or more than 25° C.

In yet another embodiment, the degradation or inactivation of auxotrophic mRNA may be triggered or induced by a change in the levels of ions in the subject. The ions may be cations or anions such as, but not limited to, sodium ions, potassium ions, chloride ions, calcium ions, magnesium ions and/or phosphate ions.

3' UTR and the AU Rich Elements

3'UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA(U/A)(U/A) nonamers. Molecules containing this type of AREs include GM-CSF and TNF-a. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of nucleic acids or mRNA of the invention. When engineering specific nucleic acids or mRNA, one or more copies of an ARE can be introduced to make nucleic acids or mRNA of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using nucleic acids or mRNA of the invention and protein production can be assayed at various time points post-transfection. For example, cells can be transfected with different ARE-engineering molecules and by using an ELISA kit to the relevant protein and assaying protein produced at 6 hr, 12 hr, 24 hr, 48 hr, and 7 days post-transfection.

3' UTR and Triple Helices

In one embodiment, nucleic acids of the present invention may include a triple helix on the 3' end of the modified nucleic acid, enhanced modified RNA or ribonucleic acid. The 3' end of the nucleic acids of the present invention may include a triple helix alone or in combination with a Poly-A tail.

In one embodiment, the nucleic acid of the present invention may comprise at least a first and a second U-rich region, a conserved stem loop region between the first and second region and an A-rich region. The first and second U-rich region and the A-rich region may associate to form a triple helix on the 3' end of the nucleic acid. This triple helix may stabilize the nucleic acid, enhance the translational efficiency of the nucleic acid and/or protect the 3' end from degradation. Exemplary triple helices include, but are not limited to, the triple helix sequence of metastasis-associated lung adenocarcinoma transcript 1 (MALAT1), MEN-β and polyadenylated nuclear (PAN) RNA (See Wilusz et al., Genes & Development 2012 26:2392-2407; herein incorporated by reference in its entirety). In one embodiment, the 3' end of the modified nucleic acids, enhanced modified RNA or ribonucleic acids of the present invention comprises a first U-rich region comprising TTTTTCTTTT (SEQ ID NO: 1), a second U-rich region comprising TTTTGCTTTT (SEQ ID NO: 2) or TTTTGCTTTT (SEQ ID NO: 3), an A-rich region comprising AAAAAGCAAAA (SEQ ID NO: 4). In another embodiment, the 3' end of the nucleic acids of the present invention comprises a triple helix formation structure comprising a first U-rich region, a conserved region, a second U-rich region and an A-rich region.

In one embodiment, the triple helix may be formed from the cleavage of a MALAT1 sequence prior to the cloverleaf structure. While not meaning to be bound by theory, MALAT1 is a long non-coding RNA which, when cleaved, forms a triple helix and a tRNA-like cloverleaf structure. The MALAT1 transcript then localizes to nuclear speckles and the tRNA-like cloverleaf localizes to the cytoplasm (Wilusz et al. Cell 2008 135(5): 919-932; herein incorporated by reference in its entirety).

As a non-limiting example, the terminal end of the nucleic acid of the present invention comprising the MALAT1 sequence can then form a triple helix structure, after RNaseP cleavage from the cloverleaf structure, which stabilizes the nucleic acid (Peart et al. *Non-mRNA 3' end formation: how the other half lives*; WIREs RNA 2013; herein incorporated by reference in its entirety).

In one embodiment, the nucleic acids or mRNA described herein comprise a MALAT1 sequence. In another embodiment, the nucleic acids or mRNA may be polyadenylated. In yet another embodiment, the nucleic acids or mRNA is not polyadenylated but has an increased resistance to degradation compared to unmodified nucleic acids or mRNA.

In one embodiment, the nucleic acids of the present invention may comprise a MALAT1 sequence in the second flanking region (e.g., the 3'UTR). As a non-limiting example, the MALAT1 sequence may be human or mouse (see e.g., the polynucleotides described in Table 37 in Example 38).

In another embodiment, the cloverleaf structure of the MALAT1 sequence may also undergo processing by RNaseZ and CCA adding enzyme to form a tRNA-like structure called mascRNA (MALAT1-associated small cytoplasmic RNA). As a non-limiting example, the mascRNA may encode a protein or a fragment thereof and/or may comprise a microRNA sequence. The mascRNA may comprise at least one chemical modification described herein.

Stem Loop

In one embodiment, the nucleic acids of the present invention may include a stem loop such as, but not limited to, a histone stem loop. The stem loop may be a nucleotide sequence that is about 25 or about 26 nucleotides in length such as, but not limited to, SEQ ID NOs: 7-17 as described in International Patent Publication No. WO2013103659, herein incorporated by reference in its entirety. The histone stem loop may be located 3' relative to the coding region (e.g., at the 3' terminus of the coding region). As a non-limiting example, the stem loop may be located at the 3' end of a nucleic acid described herein.

In one embodiment, the stem loop may be located in the second terminal region. As a non-limiting example, the stem loop may be located within an untranslated region (e.g., 3'UTR) in the second terminal region.

In one embodiment, the nucleic acid such as, but not limited to mRNA, which comprises the histone stem loop may be stabilized by the addition of at least one chain terminating nucleoside. Not wishing to be bound by theory, the addition of at least one chain terminating nucleoside may slow the degradation of a nucleic acid and thus can increase the half-life of the nucleic acid.

In one embodiment, the chain terminating nucleoside may be, but is not limited to, those described in International Patent Publication No. WO2013103659, herein incorporated by reference in its entirety. In another embodiment, the chain terminating nucleosides which may be used with the present invention includes, but is not limited to, 3'-deoxyadenosine (cordycepin), 3'-deoxyuridine, 3'-deoxycytosine, 3'-deoxyguanosine, 3'-deoxythymine, 2',3'-dideoxynucleosides, such as 2',3'-dideoxyadenosine, 2',3'-dideoxyuridine, 2',3'-dideoxycytosine, 2',3'-dideoxyguanosine, 2',3'-dideoxythymine, a 2'-deoxynucleoside, or a —O— methylnucleoside.

In another embodiment, the nucleic acid such as, but not limited to mRNA, which comprises the histone stem loop may be stabilized by a modification to the 3' region of the nucleic acid that can prevent and/or inhibit the addition of oligo(U) (see e.g., International Patent Publication No. WO2013103659, herein incorporated by reference in its entirety).

In yet another embodiment, the nucleic acid such as, but not limited to mRNA, which comprises the histone stem loop may be stabilized by the addition of an oligonucleotide that terminates in a 3'-deoxynucleoside, 2',3'-dideoxynucleoside, 3'-0-methylnucleosides, 3'-0-ethylnucleosides, 3'-arabinosides, and other modified nucleosides known in the art and/or described herein.

In one embodiment, the nucleic acids of the present invention may include a histone stem loop, a polyA tail sequence and/or a 5' cap structure. The histone stem loop may be before and/or after the polyA tail sequence. The nucleic acids comprising the histone stem loop and a polyA tail sequence may include a chain terminating nucleoside described herein.

In another embodiment, the nucleic acids of the present invention may include a histone stem loop and a 5' cap structure. The 5' cap structure may include, but is not limited to, those described herein and/or known in the art.

In one embodiment, the conserved stem loop region may comprise a miR sequence described herein. As a non-limiting example, the stem loop region may comprise the seed sequence of a miR sequence described herein. In another non-limiting example, the stem loop region may comprise a miR-122 seed sequence.

In another embodiment, the conserved stem loop region may comprise a miR sequence described herein and may also include a TEE sequence.

In one embodiment, the incorporation of a miR sequence and/or a TEE sequence changes the shape of the stem loop region which may increase and/or decrease translation. (see e.g, Kedde et al. A Pumilio-induced RNA structure switch in p27-3'UTR controls miR-221 and miR-22 accessibility. Nature Cell Biology. 2010, herein incorporated by reference in its entirety).

In one embodiment, the modified nucleic acids described herein may comprise at least one histone stem-loop and a polyA sequence or polyadenylation signal. Non-limiting examples of nucleic acid sequences encoding for at least one histone stem-loop and a polyA sequence or a polyadenylation signal are described in International Patent Publication No. WO2013120497, WO2013120629, WO2013120500, WO2013120627, WO2013120498, WO2013120626, WO2013120499 and WO2013120628, the contents of each of which is herein incorporated by reference in their entirety. In one embodiment, the nucleic acid encoding for a histone stem loop and a polyA sequence or a polyadenylation signal may code for a pathogen antigen or fragment thereof such as the nucleic acid sequences described in International Patent Publication No WO2013120499 and WO2013120628, the contents of which is herein incorporated by reference in its entirety. In another embodiment, the nucleic acid encoding for a histone stem loop and a polyA sequence or a polyadenylation signal may code for a therapeutic protein such as the nucleic acid sequences described in International Patent Publication No WO2013120497 and WO2013120629, the contents of which is herein incorporated by reference in its entirety. In one embodiment, the nucleic acid encoding for a histone stem loop and a polyA sequence or a polyadenylation signal may code for a tumor antigen or fragment thereof such as the nucleic acid sequences described in International Patent Publication No WO2013120500 and WO2013120627, the contents of which is herein incorporated by reference in its entirety. In another embodiment, the nucleic acid encoding for a histone stem loop and a polyA sequence or a polyadenylation signal may code for a allergenic antigen or an autoimmune self-antigen such as the nucleic acid sequences described in International Patent Publication No WO2013120498 and WO2013120626, the contents of which is herein incorporated by reference in its entirety.

5' Capping

The 5' cap structure of an mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

Modifications to the nucleic acids of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thio-guanosine nucleotides according to the manufacturer's instructions to create a phosphorothioate linkage in the 5'-ppp-5' cap. Additional modified guanosine nucleotides may be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the mRNA (as mentioned above) on the 2'-hydroxyl group of the sugar ring. Multiple distinct 5'-cap structures can be used to generate the 5'-cap of a nucleic acid molecule, such as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/linked to a nucleic acid molecule.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3' mppp-G; which may equivalently be designated 3' O-Me-m7G(5')ppp(5')G). The 3'-O atom of the other, unmodified, guanine becomes linked to the 5'-terminal nucleotide of the capped nucleic acid molecule (e.g. an mRNA or mmRNA). The N7- and 3'-O-methylated guanine provides the terminal moiety of the capped nucleic acid molecule (e.g. mRNA or mmRNA).

Another exemplary cap is mCAP, which is similar to ARCA but has a 2'-β-methyl group on guanosine (i.e., N7,2'-O-dimethyl-guanosine-5'-triphosphate-5'-guanosine, m$^7$Gm-ppp-G).

In one embodiment, the cap is a dinucleotide cap analog. As a non-limiting example, the dinucleotide cap analog may be modified at different phosphate positions with a boranophosphate group or a phosphoroselenoate group such as the dinucleotide cap analogs described in U.S. Pat. No. 8,519, 110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dinucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present invention is a 4-chloro/bromophenoxyethyl analog.

While cap analogs allow for the concomitant capping of a nucleic acid molecule in an in vitro transcription reaction, up to 20% of transcripts remain uncapped. This, as well as the structural differences of a cap analog from an endogenous 5'-cap structures of nucleic acids produced by the endogenous, cellular transcription machinery, may lead to reduced translational competency and reduced cellular stability.

Modified nucleic acids of the invention may also be capped post-transcriptionally, using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5' cap structures of the present invention are those which, among other things, have enhanced binding of cap binding proteins, increased half life, reduced susceptibility to 5' endonucleases and/or reduced 5' decapping, as compared to synthetic 5' cap structures known in the art (or to a wild-type, natural or physiological 5' cap structure). For example, recombinant Vaccinia Virus Capping Enzyme and recombinant 2'-O-methyltransferase enzyme can create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5' cap analog structures known in the art. Cap structures include 7mG(5')ppp(5')N,pN2p (cap 0), 7mG(5')ppp(5')NlmpNp (cap 1), 7mG(5')-ppp(5') NlmpN2 mp (cap 2) and m(7)Gpppm(3)(6,6,2')Apm(2') Apm(2')Cpm(2)(3,2')Up (cap 4).

Because the modified nucleic acids may be capped post-transcriptionally, and because this process is more efficient, nearly 100% of the modified nucleic acids may be capped. This is in contrast to ~80% when a cap analog is linked to an mRNA in the course of an in vitro transcription reaction.

According to the present invention, 5' terminal caps may include endogenous caps or cap analogs. According to the present invention, a 5' terminal cap may comprise a guanine analog. Useful guanine analogs include inosine, N1-methyl-guanosine, 2' fluoro-guanosine, 7-deaza-guanosine, 8-oxo-guanosine, 2-amino-guanosine, LNA-guanosine, and 2-azido-guanosine.

In one embodiment, the nucleic acids described herein may contain a modified 5' cap. A modification on the 5' cap may increase the stability of mRNA, increase the half-life of the mRNA, and could increase the mRNA translational efficiency. The modified 5' cap may include, but is not limited to, one or more of the following modifications: modification at the 2' and/or 3' position of a capped guanosine triphosphate (GTP), a replacement of the sugar ring oxygen (that produced the carbocyclic ring) with a methylene moiety (CH$_2$), a modification at the triphosphate bridge moiety of the cap structure, or a modification at the nucleobase (G) moiety.

The 5' cap structure that may be modified includes, but is not limited to, the caps described herein such as Cap0 having the substrate structure for cap dependent translation of:

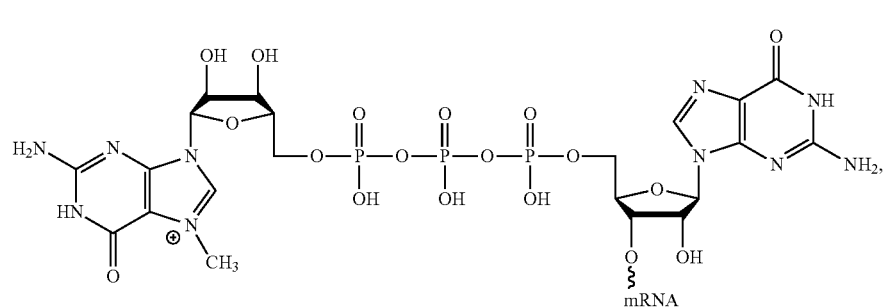
(CAP-001)

or Cap1 having the substrate structure for cap dependent translation of:

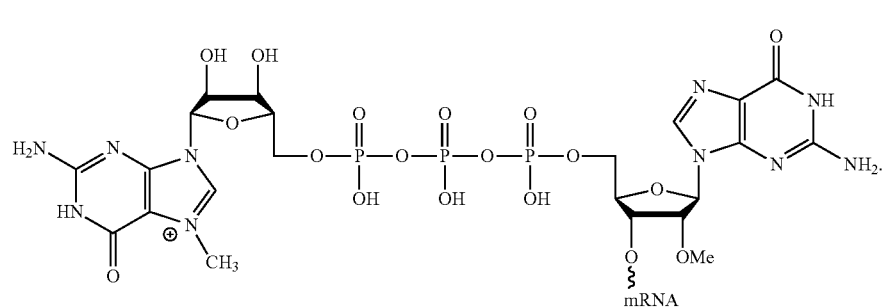
(CAP-002)

As a non-limiting example, the modified 5' cap may have the substrate structure for cap dependent translation of:

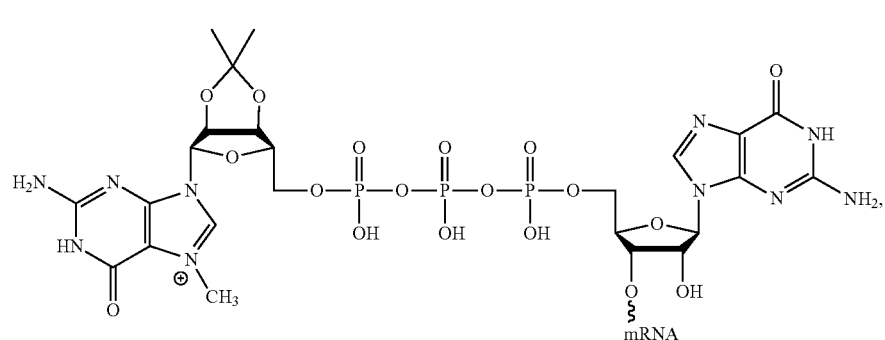
(CAP-003)

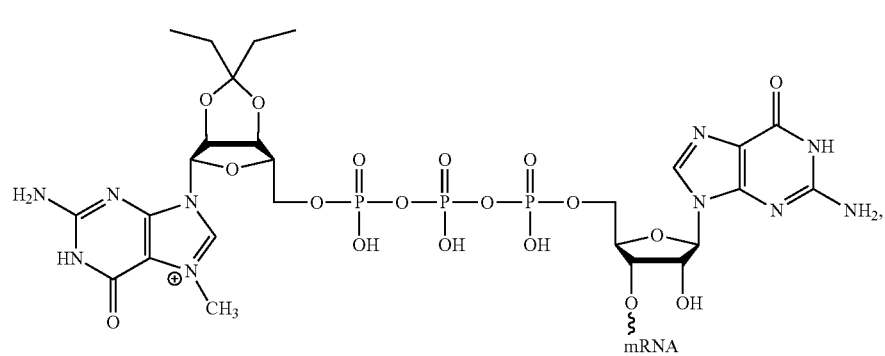
(CAP-004)

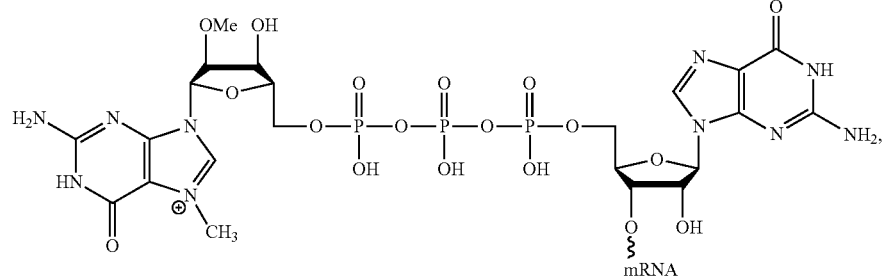
(CAP-005)
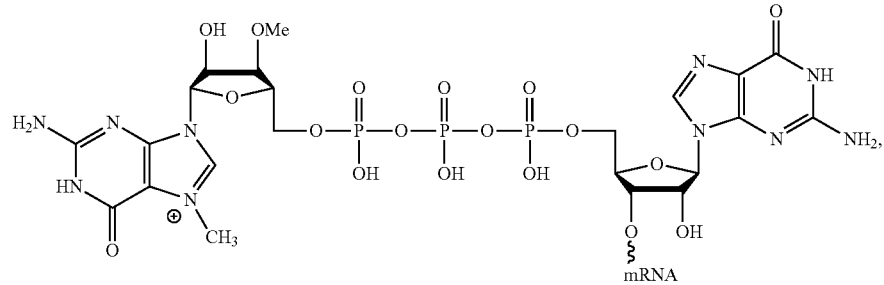
(CAP-006)
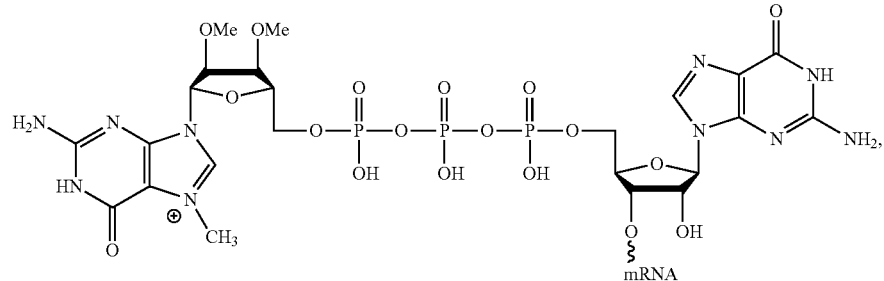
(CAP-007)
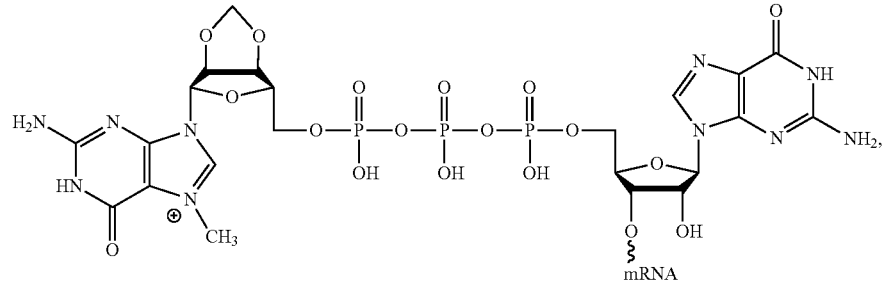
(CAP-008)
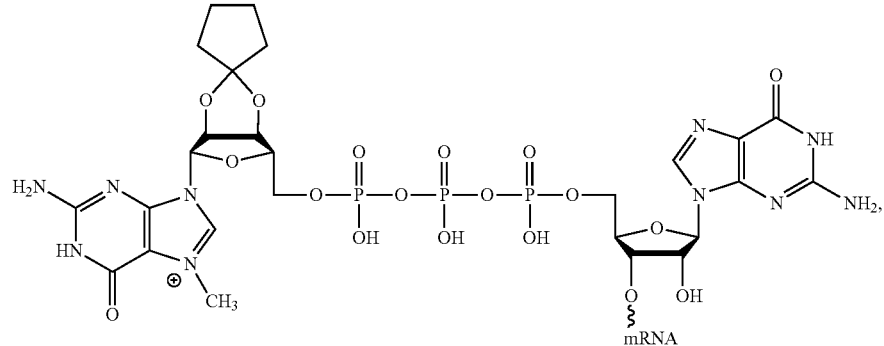
(CAP-009)

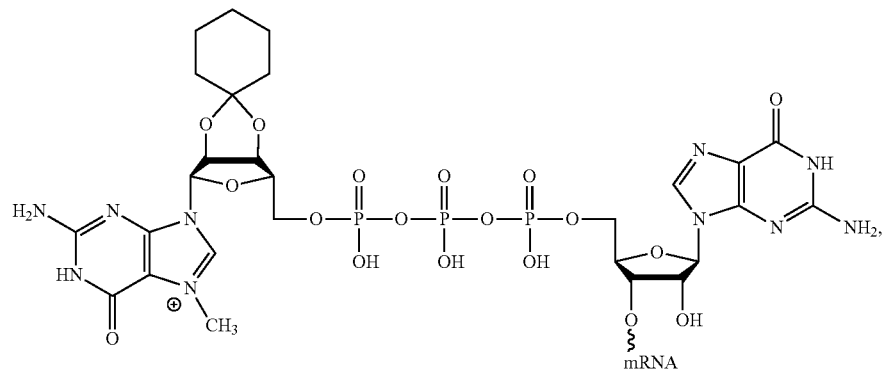
(CAP-010)
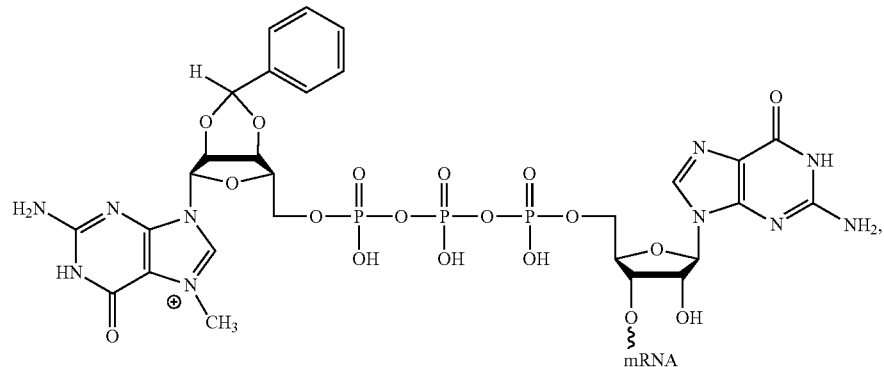
(CAP-011)
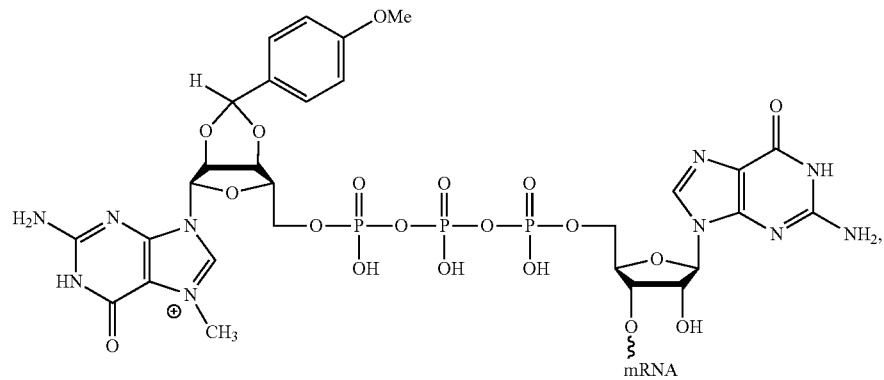
(CAP-012)
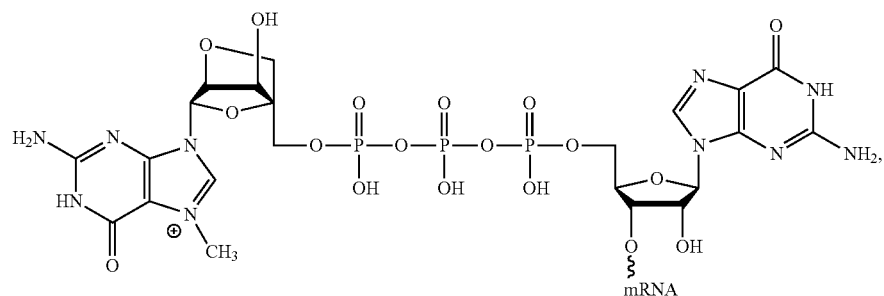
(CAP-013)

(CAP-014)
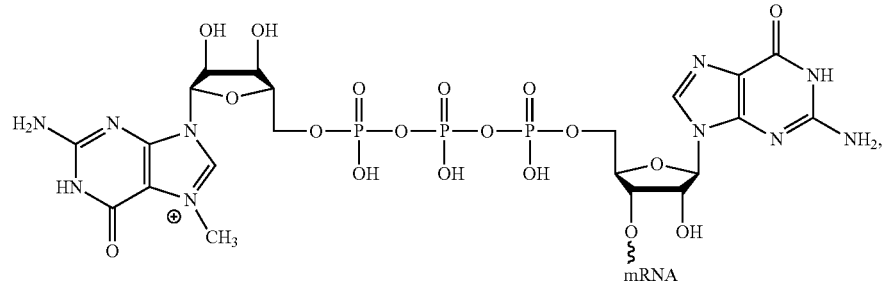
(CAP-015)
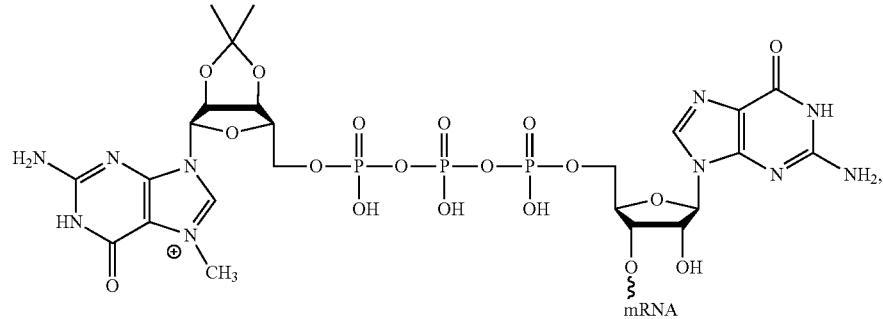
(CAP-016)
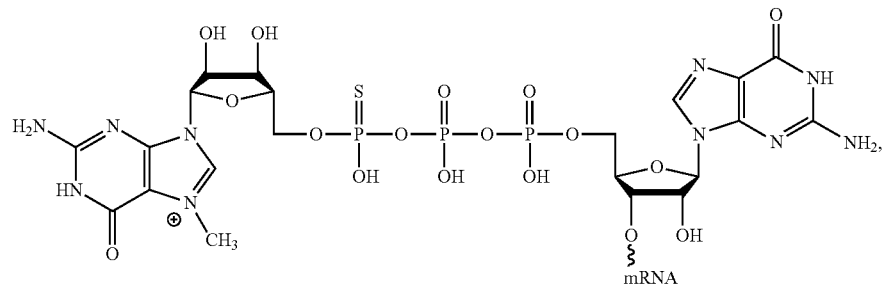
(CAP-017)
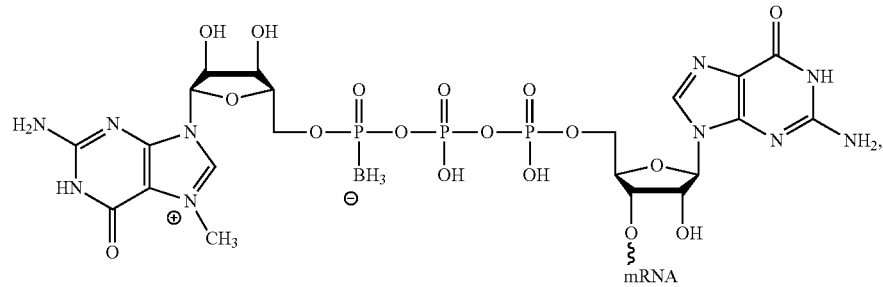
(CAP-018)
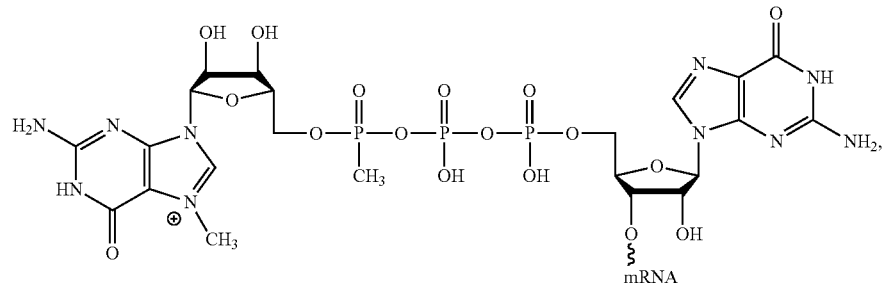

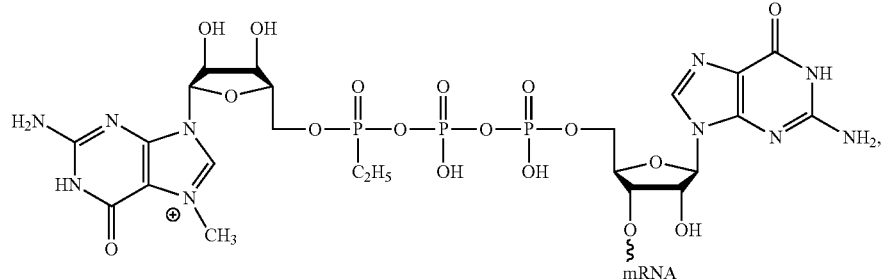
(CAP-019)

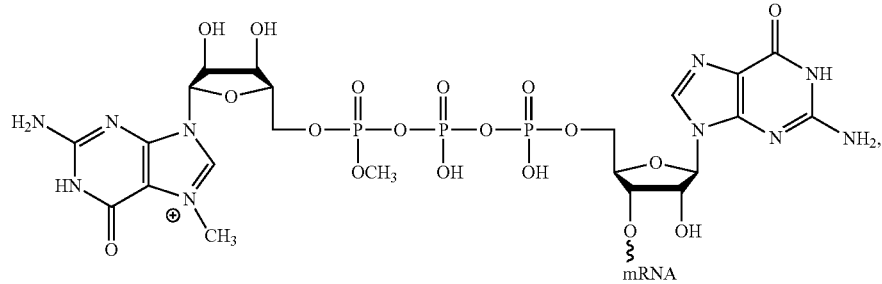
(CAP-020)

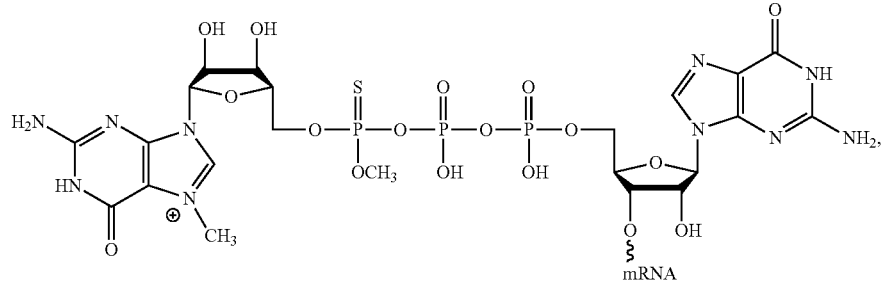
(CAP-021)

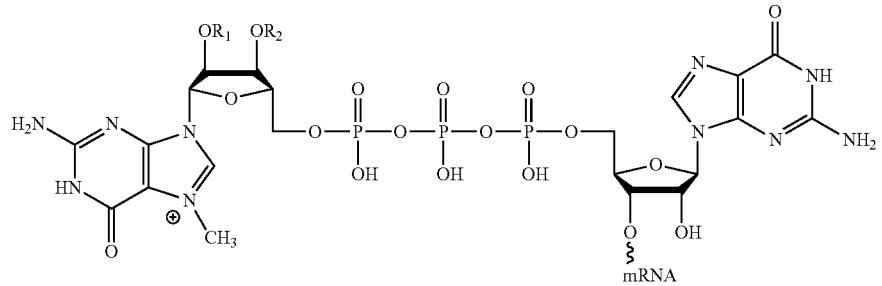

where $R_1$ and $R_2$ are defined in Table 1:

TABLE 1

| Cap Structure Number | $R_1$ | $R_2$ |
| --- | --- | --- |
| CAP-022 | $C_2H_5$ (Ethyl) | H |
| CAP-023 | H | $C_2H_5$ (Ethyl) |
| CAP-024 | $C_2H_5$ (Ethyl) | $C_2H_5$ (Ethyl) |
| CAP-025 | $C_3H_7$ (Propyl) | H |
| CAP-026 | H | $C_3H_7$ (Propyl) |
| CAP-027 | $C_3H_7$ (Propyl) | $C_3H_7$ (Propyl) |
| CAP-028 | $C_4H_9$ (Butyl) | H |
| CAP-029 | H | $C_4H_9$ (Butyl) |
| CAP-030 | $C_4H_9$ (Butyl) | $C_4H_9$ (Butyl) |
| CAP-031 | $C_5H_{11}$ (Pentyl) | H |
| CAP-032 | H | $C_5H_{11}$ (Pentyl) |
| CAP-033 | $C_5H_{11}$ (Pentyl) | $C_5H_{11}$ (Pentyl) |
| CAP-034 | $H_2C$—C≡CH (Propargyl) | H |
| CAP-035 | H | $H_2C$—C≡CH (Propargyl) |

TABLE 1-continued

| Cap Structure Number | R$_1$ | R$_2$ |
|---|---|---|
| CAP-036 | H$_2$C—C≡CH (Propargyl) | H$_2$C—C≡CH (Propargyl) |
| CAP-037 | CH$_2$CH=CH$_2$ (Allyl) | H |
| CAP-038 | H | CH$_2$CH=CH$_2$ (Allyl) |
| CAP-039 | CH$_2$CH=CH$_2$ (Allyl) | CH$_2$CH=CH$_2$ (Allyl) |
| CAP-040 | CH$_2$OCH$_3$ (MOM) | H |
| CAP-041 | H | CH$_2$OCH$_3$ (MOM) |
| CAP-042 | CH$_2$OCH$_3$ (MOM) | CH$_2$OCH$_3$ (MOM) |
| CAP-043 | CH$_2$OCH$_2$CH$_2$OCH$_3$ (MEM) | H |
| CAP-044 | H | CH$_2$OCH$_2$CH$_2$OCH$_3$ (MEM) |
| CAP-045 | CH$_2$OCH$_2$CH$_2$OCH$_3$ (MEM) | CH$_2$OCH$_2$CH$_2$OCH$_3$ (MEM) |
| CAP-046 | CH$_2$SCH$_3$ (MTM) | H |
| CAP-047 | H | CH$_2$SCH$_3$ (MTM) |
| CAP-048 | CH$_2$SCH$_3$ (MTM) | CH$_2$SCH$_3$ (MTM) |
| CAP-049 | CH$_2$C$_6$H$_5$ (Benzyl) | H |
| CAP-050 | H | CH$_2$C$_6$H$_5$ (Benzyl) |
| CAP-051 | CH$_2$C$_6$H$_5$ (Benzyl) | CH$_2$C$_6$H$_5$ (Benzyl) |
| CAP-052 | CH$_2$OCH$_2$C$_6$H$_5$ (BOM) | H |
| CAP-053 | H | CH$_2$OCH$_2$C$_6$H$_5$ (BOM) |
| CAP-054 | CH$_2$OCH$_2$C$_6$H$_5$ (BOM) | CH$_2$OCH$_2$C$_6$H$_5$ (BOM) |
| CAP-055 | CH$_2$C$_6$H$_4$—OMe (p-Methoxybenzyl) | H |
| CAP-056 | H | CH$_2$C$_6$H$_4$—OMe (p-Methoxybenzyl) |
| CAP-057 | CH$_2$C$_6$H$_4$—OMe (p-Methoxybenzyl) | CH$_2$C$_6$H$_4$—OMe (p-Methoxybenzyl) |
| CAP-058 | CH$_2$C$_6$H$_4$—NO$_2$ (p-Nitrobenzyl) | H |
| CAP-059 | H | CH$_2$C$_6$H$_4$—NO$_2$ (p-Nitrobenzyl) |
| CAP-060 | CH$_2$C$_6$H$_4$—NO$_2$ (p-Nitrobenzyl) | CH$_2$C$_6$H$_4$—NO$_2$ (p-Nitrobenzyl) |
| CAP-061 | CH$_2$C$_6$H$_4$—X (p-Halobenzyl) where X=F, Cl, Br or I | H |
| CAP-062 | H | CH$_2$C$_6$H$_4$—X (p-Halobenzyl) where X=F, Cl, Br or I |
| CAP-063 | CH$_2$C$_6$H$_4$—X (p-Halobenzyl) where X=F, Cl, Br or I | CH$_2$C$_6$H$_4$—X (p-Halobenzyl) where X=F, Cl, Br or I |
| CAP-064 | CH$_2$C$_6$H$_4$—N$_3$ (p-Azidobenzyl) | H |
| CAP-065 | H | CH$_2$C$_6$H$_4$—N$_3$ (p-Azidobenzyl) |
| CAP-066 | CH$_2$C$_6$H$_4$—N$_3$ (p-Azidobenzyl) | CH$_2$C$_6$H$_4$—N$_3$ (p-Azidobenzyl) |
| CAP-067 | CH$_2$C$_6$H$_4$—CF$_3$ (p-Trifluoromethylbenzyl) | H |
| CAP-068 | H | CH$_2$C$_6$H$_4$—CF$_3$ (p-Trifluoromethylbenzyl) |
| CAP-069 | CH$_2$C$_6$H$_4$—CF$_3$ (p-Trifluoromethylbenzyl) | CH$_2$C$_6$H$_4$—CF$_3$ (p-Trifluoromethylbenzyl) |
| CAP-070 | CH$_2$C$_6$H$_4$—OCF$_3$ (p-Trifluoromethoxylbenzyl) | H |
| CAP-071 | H | CH$_2$C$_6$H$_4$—OCF$_3$ (p-Trifluoromethoxylbenzyl) |
| CAP-072 | CH$_2$C$_6$H$_4$—OCF$_3$ (p-Trifluoromethoxylbenzyl) | CH$_2$C$_6$H$_4$—OCF$_3$ (p-Trifluoromethoxylbenzyl) |
| CAP-073 | CH$_2$C$_6$H$_3$—(CF$_3$)$_2$ [2,4-bis(Trifluoromethyl)benzyl] | H |
| CAP-074 | H | CH$_2$C$_6$H$_3$—(CF$_3$)$_2$ [2,4-bis(Trifluoromethyl)benzyl] |
| CAP-075 | CH$_2$C$_6$H$_3$—(CF$_3$)$_2$ [2,4-bis(Trifluoromethyl)benzyl] | CH$_2$C$_6$H$_3$—(CF$_3$)$_2$ [2,4-bis(Trifluoromethyl)benzyl] |
| CAP-076 | Si(C$_6$H$_5$)$_2$C$_4$H$_9$ (t-Butyldiphenylsilyl) | H |
| CAP-077 | H | Si(C$_6$H$_5$)$_2$C$_4$H$_9$ (t-Butyldiphenylsilyl) |
| CAP-078 | Si(C$_6$H$_5$)$_2$C$_4$H$_9$ (t-Butyldiphenylsilyl) | Si(C$_6$H$_5$)$_2$C$_4$H$_9$ (t-Butyldiphenylsilyl) |
| CAP-079 | CH$_2$CH$_2$CH=CH$_2$ (Homoallyl) | H |
| CAP-080 | H | CH$_2$CH$_2$CH=CH$_2$ (Homoallyl) |
| CAP-081 | CH$_2$CH$_2$CH=CH$_2$ (Homoallyl) | CH$_2$CH$_2$CH=CH$_2$ (Homoallyl) |
| CAP-082 | P(O)(OH)$_2$ (MP) | H |
| CAP-083 | H | P(O)(OH)$_2$ (MP) |
| CAP-084 | P(O)(OH)$_2$ (MP) | P(O)(OH)$_2$ (MP) |
| CAP-085 | P(S)(OH)$_2$ (Thio-MP) | H |
| CAP-086 | H | P(S)(OH)$_2$ (Thio-MP) |
| CAP-087 | P(S)(OH)$_2$ (Thio-MP) | P(S)(OH)$_2$ (Thio-MP) |
| CAP-088 | P(O)(CH$_3$)(OH) (Methylphophonate) | H |
| CAP-089 | H | P(O)(CH$_3$)(OH) (Methylphophonate) |
| CAP-090 | P(O)(CH$_3$)(OH) (Methylphophonate) | P(O)(CH$_3$)(OH) (Methylphophonate) |
| CAP-091 | PN($^i$Pr)$_2$(OCH$_2$CH$_2$CN) (Phosporamidite) | H |

TABLE 1-continued

| Cap Structure Number | R₁ | R₂ |
|---|---|---|
| CAP-092 | H | PN($^i$Pr)$_2$(OCH$_2$CH$_2$CN) (Phosporamidite) |
| CAP-093 | PN($^i$Pr)$_2$(OCH$_2$CH$_2$CN) (Phosporamidite) | PN($^i$Pr)$_2$(OCH$_2$CH$_2$CN) (Phosporamidite) |
| CAP-094 | SO$_2$CH$_3$ (Methanesulfonic acid) | H |
| CAP-095 | H | SO$_2$CH$_3$ (Methanesulfonic acid) |
| CAP-096 | SO$_2$CH$_3$ (Methanesulfonic acid) | SO$_2$CH$_3$ (Methanesulfonic acid) | or

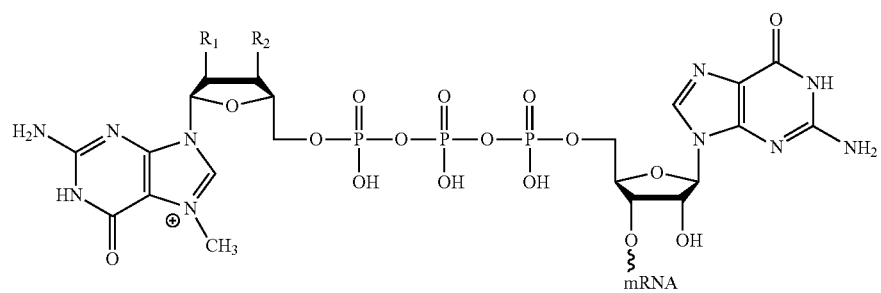

where R$_1$ and R$_2$ are defined in Table 2:

TABLE 2

| Cap Structure Number | R1 | R2 |
|---|---|---|
| CAP-097 | NH$_2$ (amino) | H |
| CAP-098 | H | NH$_2$ (amino) |
| CAP-099 | NH$_2$ (amino) | NH$_2$ (amino) |
| CAP-100 | N$_3$ (Azido) | H |
| CAP-101 | H | N$_3$ (Azido) |
| CAP-102 | N$_3$ (Azido) | N$_3$ (Azido) |
| CAP-103 | X (Halo: F, Cl, Br, I) | H |
| CAP-104 | H | X (Halo: F, Cl, Br, I) |
| CAP-105 | X (Halo: F, Cl, Br, I) | X (Halo: F, Cl, Br, I) |
| CAP-106 | SH (Thiol) | H |
| CAP-107 | H | SH (Thiol) |
| CAP-108 | SH (Thiol) | SH (Thiol) |
| CAP-109 | SCH$_3$ (Thiomethyl) | H |
| CAP-110 | H | SCH$_3$ (Thiomethyl) |
| CAP-111 | SCH$_3$ (Thiomethyl) | SCH$_3$ (Thiomethyl) |

In Table 1, "MOM" stands for methoxymethyl, "MEM" stands for methoxyethoxymethyl, "MTM" stands for methylthiomethyl, "BOM" stands for benzyloxymethyl and "MP" stands for monophosphonate. In Table 1 and 2, "F" stands for fluorine, "Cl" stands for chlorine, "Br" stands for bromine and "I" stands for iodine.

In a non-limiting example, the modified 5' cap may have the substrate structure for vaccinia mRNA capping enzyme of:

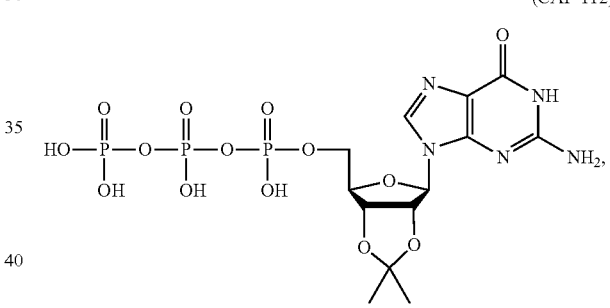

(CAP-112)

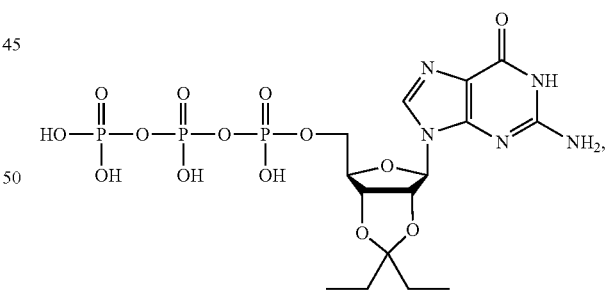

(CAP-113)

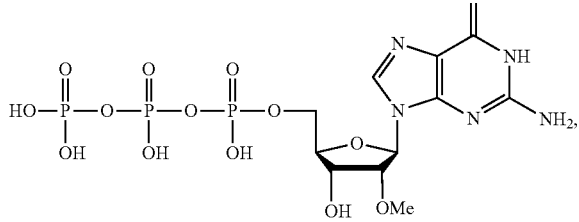

(CAP-114)

(CAP-115)
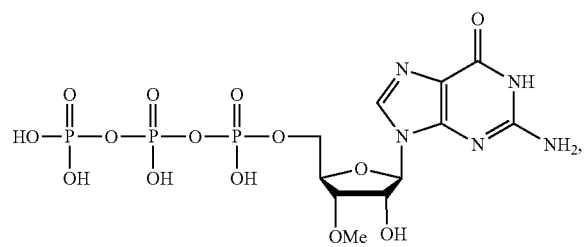
(CAP-116)
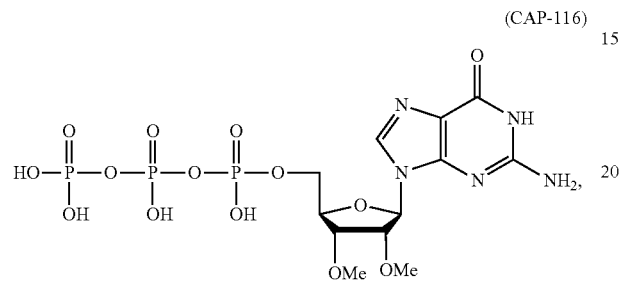
(CAP-117)
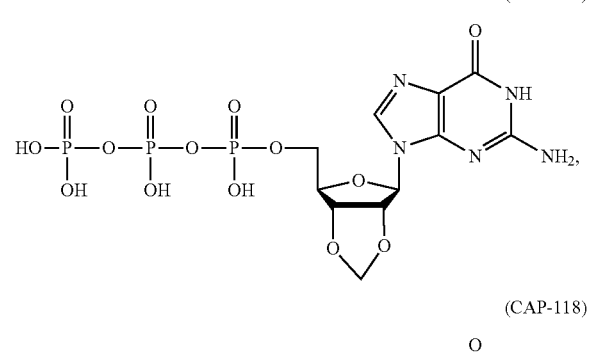
(CAP-118)
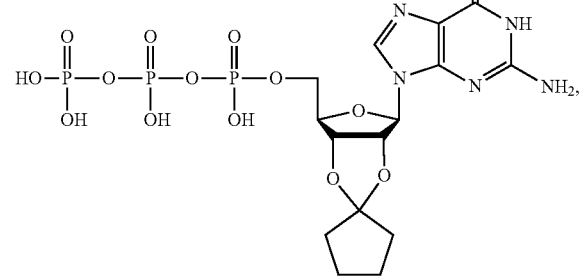
(CAP-119)
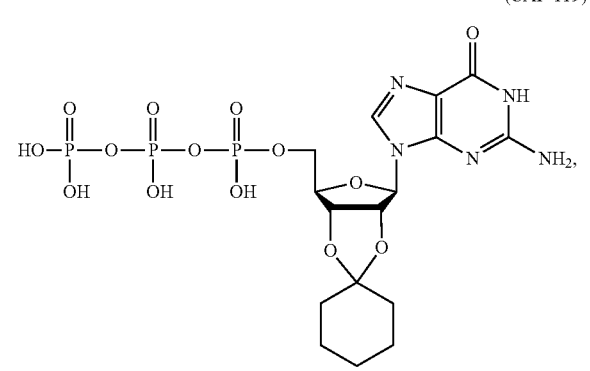
(CAP-120)
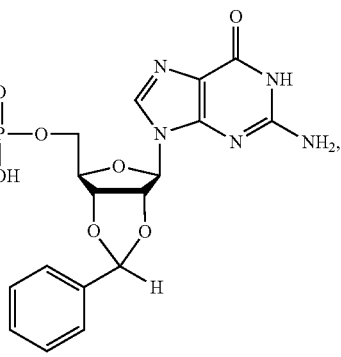
(CAP-121)
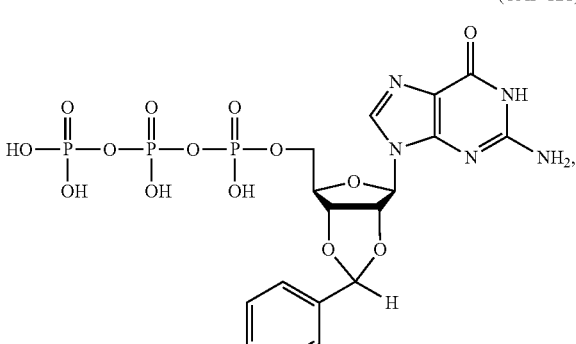
(CAP-122)
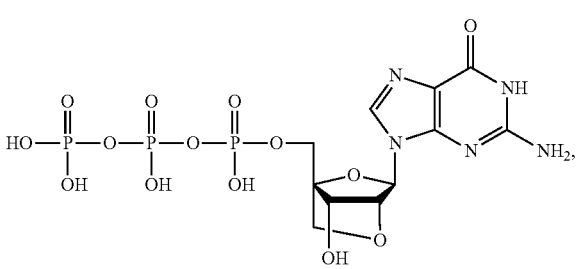
(CAP-123)
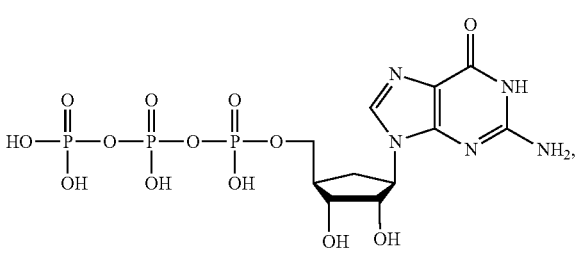
(CAP-124)
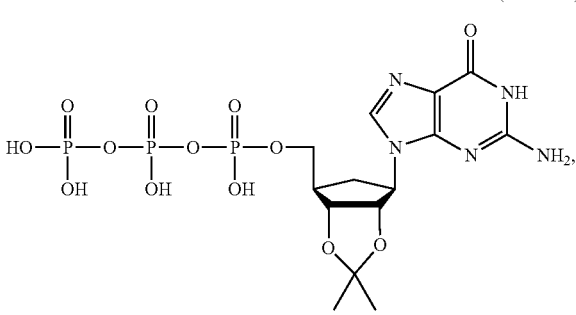

(CAP-125)
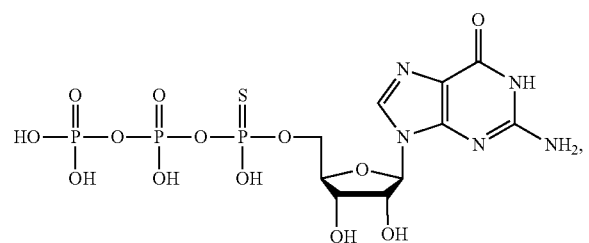
(CAP-126)
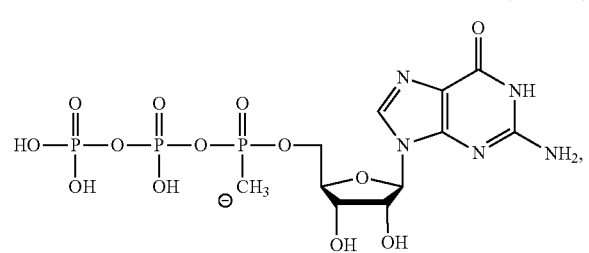
(CAP-127)
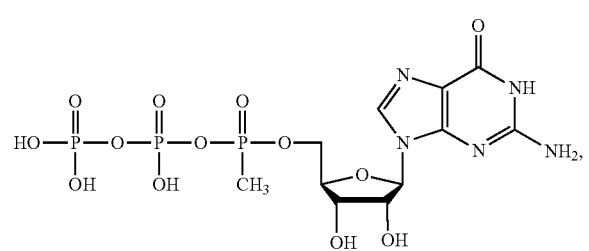
(CAP-128)
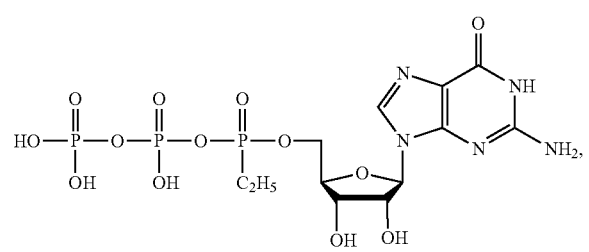
(CAP-129)
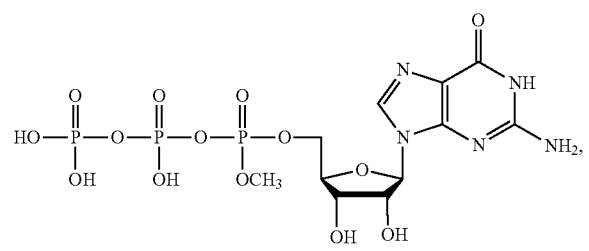
(CAP-130)
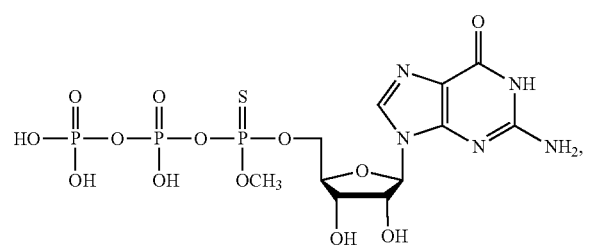
(CAP-131)
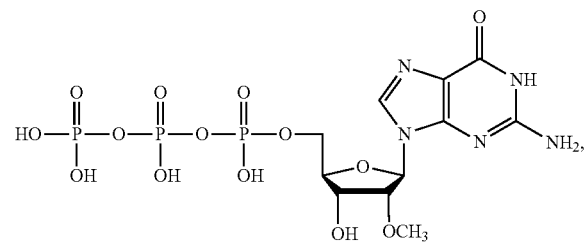
(CAP-132)
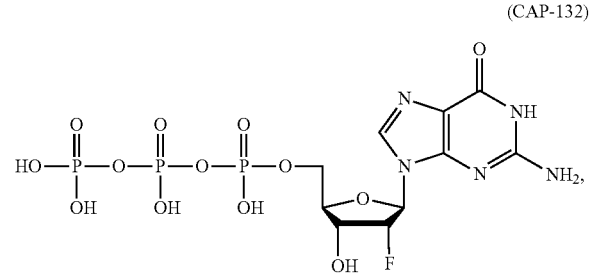
(CAP-133)
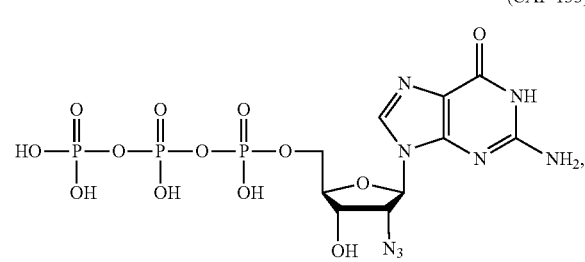
(CAP-134)
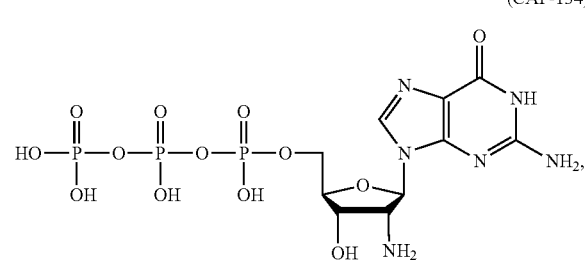
(CAP-135)
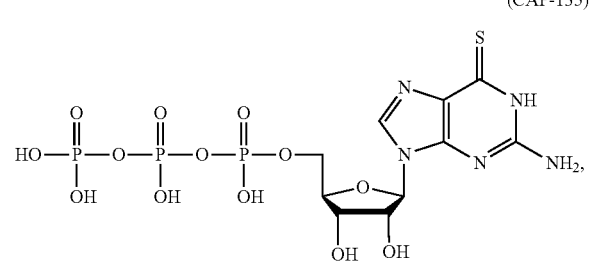
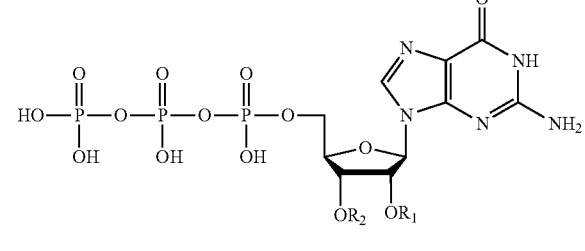

where $R_1$ and $R_2$ are defined in Table 3:

TABLE 3

| Cap Structure Number | $R_1$ | $R_2$ |
| --- | --- | --- |
| CAP-136 | $C_2H_5$ (Ethyl) | H |
| CAP-137 | H | $C_2H_5$ (Ethyl) |
| CAP-138 | $C_2H_5$ (Ethyl) | $C_2H_5$ (Ethyl) |
| CAP-139 | $C_3H_7$ (Propyl) | H |
| CAP-140 | H | $C_3H_7$ (Propyl) |
| CAP-141 | $C_3H_7$ (Propyl) | $C_3H_7$ (Propyl) |
| CAP-142 | $C_4H_9$ (Butyl) | H |
| CAP-143 | H | $C_4H_9$ (Butyl) |
| CAP-144 | $C_4H_9$ (Butyl) | $C_4H_9$ (Butyl) |
| CAP-145 | $C_5H_{11}$ (Pentyl) | H |
| CAP-146 | H | $C_5H_{11}$ (Pentyl) |
| CAP-147 | $C_5H_{11}$ (Pentyl) | $C_5H_{11}$ (Pentyl) |
| CAP-148 | $H_2C-C\equiv CH$ (Propargyl) | H |
| CAP-149 | H | $H_2C-C\equiv CH$ (Propargyl) |
| CAP-150 | $H_2C-C\equiv CH$ (Propargyl) | $H_2C-C\equiv CH$ (Propargyl) |
| CAP-151 | $CH_2CH=CH_2$ (Allyl) | H |
| CAP-152 | H | $CH_2CH=CH_2$ (Allyl) |
| CAP-153 | $CH_2CH=CH_2$ (Allyl) | $CH_2CH=CH_2$ (Allyl) |
| CAP-154 | $CH_2OCH_3$ (MOM) | H |
| CAP-155 | H | $CH_2OCH_3$ (MOM) |
| CAP-156 | $CH_2OCH_3$ (MOM) | $CH_2OCH_3$ (MOM) |
| CAP-157 | $CH_2OCH_2CH_2OCH_3$ (MEM) | H |
| CAP-158 | H | $CH_2OCH_2CH_2OCH_3$ (MEM) |
| CAP-159 | $CH_2OCH_2CH_2OCH_3$ (MEM) | $CH_2OCH_2CH_2OCH_3$ (MEM) |
| CAP-160 | $CH_2SCH_3$ (MTM) | H |
| CAP-161 | H | $CH_2SCH_3$ (MTM) |
| CAP-162 | $CH_2SCH_3$ (MTM) | $CH_2SCH_3$ (MTM) |
| CAP-163 | $CH_2C_6H_5$ (Benzyl) | H |
| CAP-164 | H | $CH_2C_6H_5$ (Benzyl) |
| CAP-165 | $CH_2C_6H_5$ (Benzyl) | $CH_2C_6H_5$ (Benzyl) |
| CAP-166 | $CH_2OCH_2C_6H_5$ (BOM) | H |
| CAP-167 | H | $CH_2OCH_2C_6H_5$ (BOM) |
| CAP-168 | $CH_2OCH_2C_6H_5$ (BOM) | $CH_2OCH_2C_6H_5$ (BOM) |
| CAP-169 | $CH_2C_6H_4-OMe$ (p-Methoxybenzyl) | H |
| CAP-170 | H | $CH_2C_6H_4-OMe$ (p-Methoxybenzyl) |
| CAP-171 | $CH_2C_6H_4-OMe$ (p-Methoxybenzyl) | $CH_2C_6H_4-OMe$ (p-Methoxybenzyl) |
| CAP-172 | $CH_2C_6H_4-NO_2$ (p-Nitrobenzyl) | H |
| CAP-173 | H | $CH_2C_6H_4-NO_2$ (p-Nitrobenzyl) |
| CAP-174 | $CH_2C_6H_4-NO_2$ (p-Nitrobenzyl) | $CH_2C_6H_4-NO_2$ (p-Nitrobenzyl) |
| CAP-175 | $CH_2C_6H_4-X$ (p-Halobenzyl) where X=F, Cl, Br or I | H |
| CAP-176 | H | $CH_2C_6H_4-X$ (p-Halobenzyl) where X=F, Cl, Br or I |
| CAP-177 | $CH_2C_6H_4-X$ (p-Halobenzyl) where X=F, Cl, Br or I | $CH_2C_6H_4-X$ (p-Halobenzyl) where X=F, Cl, Br or I |
| CAP-178 | $CH_2C_6H_4-N_3$ (p-Azidobenzyl) | H |
| CAP-179 | H | $CH_2C_6H_4-N_3$ (p-Azidobenzyl) |
| CAP-180 | $CH_2C_6H_4-N_3$ (p-Azidobenzyl) | $CH_2C_6H_4-N_3$ (p-Azidobenzyl) |
| CAP-181 | $CH_2C_6H_4-CF_3$ (p-Trifluoromethylbenzyl) | H |
| CAP-182 | H | $CH_2C_6H_4-CF_3$ (p-Trifluoromethylbenzyl) |
| CAP-183 | $CH_2C_6H_4-CF_3$ (p-Trifluoromethylbenzyl) | $CH_2C_6H_4-CF_3$ (p-Trifluoromethylbenzyl) |
| CAP-184 | $CH_2C_6H_4-OCF_3$ (p-Trifluoromethoxylbenzyl) | H |
| CAP-185 | H | $CH_2C_6H_4-OCF_3$ (p-Trifluoromethoxylbenzyl) |
| CAP-186 | $CH_2C_6H_4-OCF_3$ (p-Trifluoromethoxylbenzyl) | $CH_2C_6H_4-OCF_3$ (p-Trifluoromethoxylbenzyl) |
| CAP-187 | $CH_2C_6H_3-(CF_3)_2$ [2,4-bis(Trifluoromethyl)benzyl] | H |
| CAP-188 | H | $CH_2C_6H_3-(CF_3)_2$ [2,4-bis(Trifluoromethyl)benzyl] |
| CAP-189 | $CH_2C_6H_3-(CF_3)_2$ [2,4-bis(Trifluoromethyl)benzyl] | $CH_2C_6H_3-(CF_3)_2$ [2,4-bis(Trifluoromethyl)benzyl] |
| CAP-190 | $Si(C_6H_5)_2C_4H_9$ (t-Butyldiphenylsilyl) | H |
| CAP-191 | H | $Si(C_6H_5)_2C_4H_9$ (t-Butyldiphenylsilyl) |
| CAP-192 | $Si(C_6H_5)_2C_4H_9$ (t-Butyldiphenylsilyl) | $Si(C_6H_5)_2C_4H_9$ (t-Butyldiphenylsilyl) |

TABLE 3-continued

| Cap Structure Number | R₁ | R₂ |
|---|---|---|
| CAP-193 | CH₂CH₂CH=CH₂ (Homoallyl) | H |
| CAP-194 | H | CH₂CH₂CH=CH₂ (Homoallyl) |
| CAP-195 | CH₂CH₂CH=CH₂ (Homoallyl) | CH₂CH₂CH=CH₂ (Homoallyl) |
| CAP-196 | P(O)(OH)₂ (MP) | H |
| CAP-197 | H | P(O)(OH)₂ (MP) |
| CAP-198 | P(O)(OH)₂ (MP) | P(O)(OH)₂ (MP) |
| CAP-199 | P(S)(OH)₂ (Thio-MP) | H |
| CAP-200 | H | P(S)(OH)₂ (Thio-MP) |
| CAP-201 | P(S)(OH)₂ (Thio-MP) | P(S)(OH)₂ (Thio-MP) |
| CAP-202 | P(O)(CH₃)(OH) (Methylphophonate) | H |
| CAP-203 | H | P(O)(CH₃)(OH) (Methylphophonate) |
| CAP-204 | P(O)(CH₃)(OH) (Methylphophonate) | P(O)(CH₃)(OH) (Methylphophonate) |
| CAP-205 | PN($^i$Pr)₂(OCH₂CH₂CN) (Phosporamidite) | H |
| CAP-206 | H | PN($^i$Pr)₂(OCH₂CH₂CN) (Phosporamidite) |
| CAP-207 | PN($^i$Pr)₂(OCH₂CH₂CN) (Phosporamidite) | PN($^i$Pr)₂(OCH₂CH₂CN) (Phosporamidite) |
| CAP-208 | SO₂CH₃ (Methanesulfonic acid) | H |
| CAP-209 | H | SO₂CH₃ (Methanesulfonic acid) |
| CAP-210 | SO₂CH₃ (Methanesulfonic acid) | SO₂CH₃ (Methanesulfonic acid) | or

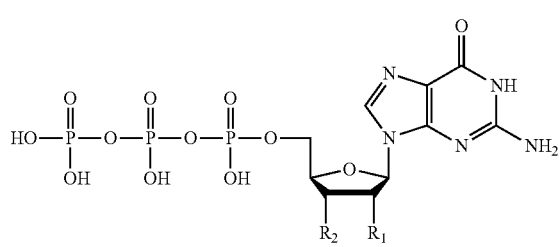

where R₁ and R₂ are defined in Table 4:

TABLE 4

| Cap Structure Number | R1 | R2 |
|---|---|---|
| CAP-211 | NH₂ (amino) | H |
| CAP-212 | H | NH₂ (amino) |
| CAP-213 | NH₂ (amino) | NH₂ (amino) |
| CAP-214 | N₃ (Azido) | H |
| CAP-215 | H | N₃ (Azido) |
| CAP-216 | N₃ (Azido) | N₃ (Azido) |
| CAP-217 | X (Halo: F, Cl, Br, I) | H |
| CAP-218 | H | X (Halo: F, Cl, Br, I) |
| CAP-219 | X (Halo: F, Cl, Br, I) | X (Halo: F, Cl, Br, I) |
| CAP-220 | SH (Thiol) | H |
| CAP-221 | H | SH (Thiol) |
| CAP-222 | SH (Thiol) | SH (Thiol) |
| CAP-223 | SCH₃ (Thiomethyl) | H |
| CAP-224 | H | SCH₃ (Thiomethyl) |
| CAP-225 | SCH₃ (Thiomethyl) | SCH₃ (Thiomethyl) |

In Table 3, "MOM" stands for methoxymethyl, "MEM" stands for methoxyethoxymethyl, "MTM" stands for methylthiomethyl, "BOM" stands for benzyloxymethyl and "MP" stands for monophosphonate. In Table 3 and 4, "F" stands for fluorine, "Cl" stands for chlorine, "Br" stands for bromine and "I" stands for iodine.

In another non-limiting example, of the modified capping structure substrates CAP-112-CAP-225 could be added in the presence of vaccinia capping enzyme with a component to create enzymatic activity such as, but not limited to, S-adenosylmethionine (AdoMet), to form a modified cap for mRNA.

In one embodiment, the replacement of the sugar ring oxygen (that produced the carbocyclic ring) with a methylene moiety (CH₂) could create greater stability to the C—N bond against phosphorylases as the C—N bond is resitant to acid or enzymatic hydrolysis. The methylene moiety may also increase the stability of the triphosphate bridge moiety and thus increasing the stability of the mRNA. As a non-limiting example, the cap substrate structure for cap dependent translation may have the structure such as, but not limited to, CAP-014 and CAP-015 and/or the cap substrate structure for vaccinia mRNA capping enzyme such as, but not limited to, CAP-123 and CAP-124. In another example, CAP-112-CAP-122 and/or CAP-125-CAP-225, can be modified by replacing the sugar ring oxygen (that produced the carbocyclic ring) with a methylene moiety (CH₂).

In another embodiment, the triphophosphate bridge may be modified by the replacement of at least one oxygen with sulfur (thio), a borane (BH₃) moiety, a methyl group, an ethyl group, a methoxy group and/or combinations thereof. This modification could increase the stability of the mRNA towards decapping enzymes. As a non-limiting example, the cap substrate structure for cap dependent translation may have the structure such as, but not limited to, CAP-016-CAP-021 and/or the cap substrate structure for vaccinia mRNA capping enzyme such as, but not limited to, CAP-125-CAP-130. In another example, CAP-003-CAP-015, CAP-022-CAP-124 and/or CAP-131-CAP-225, can be modified on the triphosphate bridge by replacing at least one of the triphosphate bridge oxygens with sulfur (thio), a borane (BH$_3$) moiety, a methyl group, an ethyl group, a methoxy group and/or combinations thereof.

In one embodiment, CAP-001-134 and/or CAP-136-CAP-225 may be modified to be a thioguanosine analog similar to CAP-135. The thioguanosine analog may comprise additional modifications such as, but not limited to, a modification at the triphosphate moiety (e.g., thio, BH$_3$, CH$_3$, C$_2$H$_5$, OCH$_3$, S and S with OCH$_3$), a modification at the 2' and/or 3' positions of 6-thio guanosine as described herein and/or a replacement of the sugar ring oxygen (that produced the carbocyclic ring) as described herein.

In one embodiment, CAP-001-121 and/or CAP-123-CAP-225 may be modified to be a modified 5' cap similar to CAP-122. The modified 5' cap may comprise additional modifications such as, but not limited to, a modification at the triphosphate moiety (e.g., thio, BH$_3$, CH$_3$, C$_2$H$_5$, OCH$_3$, S and S with OCH$_3$), a modification at the 2' and/or 3' positions of 6-thio guanosine as described herein and/or a replacement of the sugar ring oxygen (that produced the carbocyclic ring) as described herein.

In one embodiment, the 5' cap modification may be the attachment of biotin or conjugation at the 2' or 3' position of a GTP.

In another embodiment, the 5' cap modification may include a CF$_2$ modified triphosphate moiety.

3' UTR and Viral Sequences

Additional viral sequences such as, but not limited to, the translation enhancer sequence of the barley yellow dwarf virus (BYDV-PAV) can be engineered and inserted in the 3' UTR of the nucleic acids or mRNA of the invention and can stimulate the translation of the construct in vitro and in vivo. Transfection experiments can be conducted in relevant cell lines at and protein production can be assayed by ELISA at 12 hr, 24 hr, 48 hr, 72 hr and day 7 post-transfection.

IRES Sequences

Further, provided are nucleic acids containing an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. Nucleic acids or mRNA containing more than one functional ribosome binding site may encode several peptides or polypeptides that are translated independently by the ribosomes ("multicistronic nucleic acid molecules"). When nucleic acids or mRNA are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Terminal Architecture Modifications: Poly-A Tails

During RNA processing, a long chain of adenine nucleotides (poly-A tail) is normally added to a messenger RNA (mRNA) molecules to increase the stability of the molecule. Immediately after transcription, the 3' end of the transcript is cleaved to free a 3' hydroxyl. Then poly-A polymerase adds a chain of adenine nucleotides to the RNA. The process, called polyadenylation, adds a poly-A tail that is between 100 and 250 residues long.

It has been discovered that unique poly-A tail lengths provide certain advantages to the modified RNAs of the present invention.

Generally, the length of a poly-A tail of the present invention is greater than 30 nucleotides in length. In another embodiment, the poly-A tail is greater than 35 nucleotides in length. In another embodiment, the length is at least 40 nucleotides. In another embodiment, the length is at least 45 nucleotides. In another embodiment, the length is at least 55 nucleotides. In another embodiment, the length is at least 60 nucleotides. In another embodiment, the length is at least 60 nucleotides. In another embodiment, the length is at least 80 nucleotides. In another embodiment, the length is at least 90 nucleotides. In another embodiment, the length is at least 100 nucleotides. In another embodiment, the length is at least 120 nucleotides. In another embodiment, the length is at least 140 nucleotides. In another embodiment, the length is at least 160 nucleotides. In another embodiment, the length is at least 180 nucleotides. In another embodiment, the length is at least 200 nucleotides. In another embodiment, the length is at least 250 nucleotides. In another embodiment, the length is at least 300 nucleotides. In another embodiment, the length is at least 350 nucleotides. In another embodiment, the length is at least 400 nucleotides. In another embodiment, the length is at least 450 nucleotides. In another embodiment, the length is at least 500 nucleotides. In another embodiment, the length is at least 600 nucleotides. In another embodiment, the length is at least 700 nucleotides. In another embodiment, the length is at least 800 nucleotides. In another embodiment, the length is at least 900 nucleotides. In another embodiment, the length is at least 1000 nucleotides. In another embodiment, the length is at least 1100 nucleotides. In another embodiment, the length is at least 1200 nucleotides. In another embodiment, the length is at least 1300 nucleotides. In another embodiment, the length is at least 1400 nucleotides. In another embodiment, the length is at least 1500 nucleotides. In another embodiment, the length is at least 1600 nucleotides. In another embodiment, the length is at least 1700 nucleotides. In another embodiment, the length is at least 1800 nucleotides. In another embodiment, the length is at least 1900 nucleotides. In another embodiment, the length is at least 2000 nucleotides. In another embodiment, the length is at least 2500 nucleotides. In another embodiment, the length is at least 3000 nucleotides.

In some embodiments, the nucleic acid or mRNA includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail may be 80 nucleotides, 120 nucleotides, 160 nucleotides in length on a modified RNA molecule described herein such as, but not limited to, the polyA tail length on the modified RNA described in Example 13.

In another embodiment, the poly-A tail may be 20, 40, 80, 100, 120, 140 or 160 nucleotides in length on a modified RNA molecule described herein such as, but not limited to, the polyA tail length on the modified RNA described in Example 44.

In one embodiment, the poly-A tail is designed relative to the length of the overall modified RNA molecule. This design may be based on the length of the coding region of the modified RNA, the length of a particular feature or region of the modified RNA (such as the mRNA), or based on the length of the ultimate product expressed from the modified RNA. When relative to any additional feature of the modified RNA (e.g., other than the mRNA portion which includes the poly-A tail) the poly-A tail may be 10, 20, 30, 40, 50, 60, 70, 80, 90 or 100% greater in length than the additional feature. The poly-A tail may also be designed as a fraction of the modified RNA to which it belongs. In this context, the poly-A tail may be 10, 20, 30, 40, 50, 60, 70, 80, or 90% or more of the total length of the construct or the total length of the construct minus the poly-A tail.

In one embodiment, engineered binding sites and/or the conjugation of nucleic acids or mRNA for Poly-A binding protein may be used to enhance expression. The engineered binding sites may be sensor sequences which can operate as binding sites for ligands of the local microenvironment of the nucleic acids and/or mRNA. As a non-limiting example, the nucleic acids and/or mRNA may comprise at least one engineered binding site to alter the binding affinity of Poly-A binding protein (PABP) and analogs thereof. The incorporation of at least one engineered binding site may increase the binding affinity of the PABP and analogs thereof.

Additionally, multiple distinct nucleic acids or mRNA may be linked together to the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection. As a non-limiting example, the transfection experiments may be used to evaluate the effect on PABP or analogs thereof binding affinity as a result of the addition of at least one engineered binding site.

In one embodiment, a polyA tail may be used to modulate translation initiation. While not wishing to be bound by theory, the polyA tail recruits PABP which in turn can interact with translation initiation complex and thus may be essential for protein synthesis.

In another embodiment, a polyA tail may also be used in the present invention to protect against 3'-5' exonuclease digestion.

In one embodiment, the nucleic acids or mRNA of the present invention are designed to include a polyA-G Quartet. The G-quartet is a cyclic hydrogen bonded array of four guanine nucleotides that can be formed by G-rich sequences in both DNA and RNA. In this embodiment, the G-quartet is incorporated at the end of the poly-A tail. The resultant nucleic acid or mRNA may be assayed for stability, protein production and other parameters including half-life at various time points. It has been discovered that the polyA-G quartet results in protein production equivalent to at least 75% of that seen using a poly-A tail of 120 nucleotides alone.

In one embodiment, the nucleic acids or mRNA of the present invention may comprise a polyA tail and may be stabilized by the addition of a chain terminating nucleoside. The nucleic acids and/or mRNA with a polyA tail may further comprise a 5' cap structure.

In another embodiment, the nucleic acids or mRNA of the present invention may comprise a polyA-G Quartet. The nucleic acids and/or mRNA with a polyA-G Quartet may further comprise a 5' cap structure.

In one embodiment, the chain terminating nucleoside which may be used to stabilize the nucleic acid or mRNA comprising a polyA tail or polyA-G Quartet may be, but is not limited to, those described in International Patent Publication No. WO2013103659, herein incorporated by reference in its entirety. In another embodiment, the chain terminating nucleosides which may be used with the present invention includes, but is not limited to, 3'-deoxyadenosine (cordycepin), 3'-deoxyuridine, 3'-deoxycytosine, 3'-deoxyguanosine, 3'-deoxythymine, 2',3'-dideoxynucleosides, such as 2',3'-dideoxyadenosine, 2',3'-dideoxyuridine, 2',3'-dideoxycytosine, 2',3'-dideoxyguanosine, 2',3'-dideoxythymine, a 2'-deoxynucleoside, or a —O— methylnucleoside.

In another embodiment, the nucleic acid such as, but not limited to mRNA, which comprise a polyA tail or a polyA-G Quartet may be stabilized by a modification to the 3' region of the nucleic acid that can prevent and/or inhibit the addition of oligo(U) (see e.g., International Patent Publication No. WO2013103659, herein incorporated by reference in its entirety).

In yet another embodiment, the nucleic acid such as, but not limited to mRNA, which comprise a polyA tail or a polyA-G Quartet may be stabilized by the addition of an oligonucleotide that terminates in a 3'-deoxynucleoside, 2',3'-dideoxynucleoside 3'-0-methylnucleosides, 3'-0-ethylnucleosides, 3'-arabinosides, and other modified nucleosides known in the art and/or described herein.

Quantification

In one embodiment, the polynucleotides, primary constructs, modified nucleic acids or mmRNA of the present invention may be quantified in exosomes derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of the polynucleotides, primary construct, modified nucleic acid or mmRNA may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of the polynucleotides, primary constructs, modified nucleic acid or mmRNA remaining or delivered. This is possible because the polynucleotides, primary constructs, modified nucleic acid or mmRNA of the present invention differ from the endogenous forms due to the structural and/or chemical modifications.

II. Design and Synthesis of Polynucleotides

Polynucleotides, primary constructs modified nucleic acids or mmRNA for use in accordance with the invention may be prepared according to any available technique including, but not limited to chemical synthesis, enzymatic synthesis, which is generally termed in vitro transcription (IVT) or enzymatic or chemical cleavage of a longer precursor, etc. Methods of synthesizing RNAs are known in the art (see, e.g., Gait, M. J. (ed.) *Oligonucleotide synthesis: a practical approach*, Oxford [Oxfordshire], Washington, D.C.: IRL Press, 1984; and Herdewijn, P. (ed.) *Oligonucleotide synthesis: methods and applications*, Methods in Molecular Biology, v. 288 (Clifton, N.J.) Totowa, N.J.: Humana Press, 2005; both of which are incorporated herein by reference).

The process of design and synthesis of the primary constructs of the invention generally includes the steps of gene construction, mRNA production (either with or without modifications) and purification. In the enzymatic synthesis method, a target polynucleotide sequence encoding the polypeptide of interest is first selected for incorporation into a vector which will be amplified to produce a cDNA template. Optionally, the target polynucleotide sequence and/or any flanking sequences may be codon optimized. The cDNA template is then used to produce mRNA through in vitro transcription (IVT). After production, the mRNA may undergo purification and clean-up processes. The steps of which are provided in more detail below.

Gene Construction

The step of gene construction may include, but is not limited to gene synthesis, vector amplification, plasmid purification, plasmid linearization and clean-up, and cDNA template synthesis and clean-up.

Gene Synthesis

Once a polypeptide of interest, or target, is selected for production, a primary construct is designed. Within the primary construct, a first region of linked nucleosides encoding the polypeptide of interest may be constructed using an open reading frame (ORF) of a selected nucleic acid (DNA or RNA) transcript. The ORF may comprise the wild type ORF, an isoform, variant or a fragment thereof. As used herein, an "open reading frame" or "ORF" is meant to refer to a nucleic acid sequence (DNA or RNA) which is capable of encoding a polypeptide of interest. ORFs often begin with the start codon, ATG and end with a nonsense or termination codon or signal.

Further, the nucleotide sequence of the first region may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the mRNA. Codon optimization tools, algorithms and services are known in the art, non-limiting examples include services from GeneArt (Life Technologies) and/or DNA2.0 (Menlo Park Calif.). In one embodiment, the ORF sequence is optimized using optimization algorithms. Codon options for each amino acid are given in Table 5.

TABLE 5

Codon Options

| Amino Acid | Single Letter Code | Codon Options |
| --- | --- | --- |
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |

TABLE 5-continued

Codon Options

| Amino Acid | Single Letter Code | Codon Options |
|---|---|---|
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocystein insertion element (SECIS) |
| Stop codons | Stop | TAA, TAG, TGA |

In one embodiment, after a nucleotide sequence has been codon optimized it may be further evaluated for regions containing restriction sites. At least one nucleotide within the restriction site regions may be replaced with another nucleotide in order to remove the restriction site from the sequence but the replacement of nucleotides does alter the amino acid sequence which is encoded by the codon optimized nucleotide sequence.

Features, which may be considered beneficial in some embodiments of the present invention, may be encoded by the primary construct and may flank the ORF as a first or second flanking region. The flanking regions may be incorporated into the primary construct before and/or after optimization of the ORF. It is not required that a primary construct contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization. Combinations of features may be included in the first and second flanking regions and may be contained within other features. For example, the ORF may be flanked by a 5' UTR which may contain a strong Kozak translational initiation signal and/or a 3' UTR which may include an oligo(dT) sequence for templated addition of a poly-A tail.

Tables 2 and 3 provide a listing of exemplary UTRs which may be utilized in the primary construct of the present invention as flanking regions. Shown in Table 6 is a representative listing of a 5'-untranslated region of the invention. Variants of 5' UTRs may be utilized wherein one or more nucleotides are added or removed to the termini, including A, T, C or G.

TABLE 6

5'-Untranslated Regions

| 5' UTR Identifier | Name/ Description | Sequence | SEQ ID NO. |
|---|---|---|---|
| Native | Wild type UTR | See wild type sequence | — |
| 5UTR-001 | Synthetic UTR | GGGAAATAAGAGAGAAAAGAAGAGTAAG AAGAAATATAAGAGCCACC | 5 |
| 5UTR-002 | Upstream UTR | GGGAGATCAGAGAGAAAAGAAGAGTAAGA AGAAATATAAGAGCCACC | 6 |
| 5UTR-003 | Upstream UTR | GGAATAAAAGTCTCAACACAACATATACA AAACAAACGAATCTCAAGCAATCAAGCAT TCTACTTCTATTGCAGCAATTTAAATCATTT CTTTTAAAGCAAAAGCAATTTTCTGAAAAT TTTCACCATTTACGAACGATAGCAAC | 7 |
| 5UTR-004 | Upstream UTR | GGGAGACAAGCUUGGCAUUCCGGUACUGU UGGUAAAGCCACC | 8 |

In another embodiment, the 5' UTR may comprise a first polynucleotide fragment and a second polynucleotide fragment where the first and second fragments may be from the same or different gene. (See e.g., US20100293625 and US20110247090, each of which is herein incorporated by reference in its entirety). As a non-limiting example, the first polynucleotide may be a fragment of the canine, human or mouse SERCA2 gene and/or the second polynucleotide fragment is a fragment of the bovine, mouse, rat or sheep beta-casein gene.

In one embodiment, the first polynucleotide fragment may be located on the 5' end of the second polynucleotide fragment. (See e.g., US20100293625 and US20110247090, each of which is herein incorporated by reference in its entirety).

In another embodiment, the first polynucleotide fragment may comprise the second intron of a sarcoplasmic/endoplasmic reticulum calcium ATPase gene and/or the second polynucleotide fragment comprises at least a portion of the 5' UTR of a eukaryotic casein gene. (See e.g., US20100293625 and US20110247090, each of which is herein incorporated by reference in its entirety). The first polynucleotide fragment may also comprise at least a portion of exon 2 and/or exon 3 of the sarcoplasmic/endoplasmic reticulum calcium ATPase gene. (See e.g., US20100293625 and US20110247090, each of which is herein incorporated by reference in its entirety).

Shown in Table 7 is a representative listing of 3'-untranslated regions of the invention. Variants of 3' UTRs may be utilized wherein one or more nucleotides are added or removed to the termini, including A, T, C or G.

TABLE 7

3'-Untranslated Regions

| 3' UTR Identifier | Name/ Description | Sequence | SEQ ID NO. |
|---|---|---|---|
| 3UTR-001 | Creatine Kinase | GCGCCTGCCCACCTGCCACCGACTGCTGGAAC CCAGCCAGTGGGAGGGCCTGGCCCACCAGAGT CCTGCTCCCTCACTCCTCGCCCCGCCCCCTGTC CCAGAGTCCCACCTGGGGGCTCTCTCCACCCTT CTCAGAGTTCCAGTTTCAACCAGAGTTCCAACC AATGGGCTCCATCCTCTGGATTCTGGCCAATGA AATATCTCCCTGGCAGGGTCCTCTTCTTTTCCC AGAGCTCCACCCCAACCAGGAGCTCTAGTTAA TGGAGAGCTCCCAGCACACTCGGAGCTTGTGC TTTGTCTCCACGCAAAGCGATAAATAAAAGCA TTGGTGGCCTTTGGTCTTTGAATAAAGCCTGAG TAGGAAGTCTAGA | 9 |
| 3UTR-002 | Myoglobin | GCCCCTGCCGCTCCCACCCCCACCCATCTGGGC CCCGGGTTCAAGAGAGAGCGGGGTCTGATCTC GTGTAGCCATATAGAGTTTGCTTCTGAGTGTCT GCTTTGTTTAGTAGAGGTGGGCAGGAGGAGCT GAGGGGCTGGGGCTGGGGTGTTGAAGTTGGCT TTGCATGCCCAGCGATGCGCCTCCCTGTGGGAT GTCATCACCCTGGGAACCGGGAGTGGCCCTTG GCTCACTGTGTTCTGCATGGTTTGGATCTGAAT TAATTGTCCTTTCTTCTAAATCCCAACCGAACT TCTTCCAACCTCCAAACTGGCTGTAACCCCAAA TCCAAGCCATTAACTACACCTGACAGTAGCAA TTGTCTGATTAATCACTGGCCCCTTGAAGACAG CAGAATGTCCCTTTGCAATGAGGAGGAGATCT GGGCTGGGCGGGCCAGCTGGGGAAGCATTTGA CTATCTGGAACTTGTGTGTGCCTCCTCAGGTAT GGCAGTGACTCACCTGGTTTTAATAAAACAAC CTGCAACATCTCATGGTCTTTGAATAAAGCCTG AGTAGGAAGTCTAGA | 10 |
| 3UTR-003 | α-actin | ACACACTCCACCTCCAGCACGCGACTTCTCAG GACGACGAATCTTCTCAATGGGGGGCGGCTG AGCTCCAGCCACCCCGCAGTCACTTTCTTTGTA ACAACTTCCGTTGCTGCCATCGTAAACTGACAC AGTGTTTATAACGTGTACATACATTAACTTATT ACCTCATTTTGTTATTTTTCGAAACAAAGCCCT GTGGAAGAAAATGGAAAACTTGAAGAAGCATT AAAGTCATTCTGTTAAGCTGCGTAAATGGTCTT TGAATAAAGCCTGAGTAGGAAGTCTAGA | 11 |
| 3UTR-004 | Albumin | CATCACATTTAAAAGCATCTCAGCCTACCATG AGAATAAGAGAAAGAAAATGAAGATCAAAAG CTTATTCATCTGTTTTTCTTTTTCGTTGGTGTAA AGCCAACACCCTGTCTAAAAAACATAAATTTC TTTAATCATTTTGCCTCTTTTCTCTGTGCTTCAA TTAATAAAAAATGGAAAGAATCTAATAGAGTG GTACAGCACTGTTATTTTCAAAGATGTGTTGC TATCCTGAAAATTCTGTAGGTTCTGTGGAAGTT CCAGTGTTCTCTCTTATTCCACTTCGGTAGAGG ATTTCTAGTTTCTTGTGGGCTAATTAAATAAAT CATTAATACTCTTCTAATGGTCTTTGAATAAAG CCTGAGTAGGAAGTCTAGA | 12 |
| 3UTR-005 | α-globin | GCTGCCTTCTGCGGGGCTTGCCTTCTGGCCATG CCCTTCTTCTCTCCCTTGCACCTGTACCTCTTGG TCTTTGAATAAAGCCTGAGTAGGAAGGCGGCC GCTCGAGCATGCATCTAGA | 13 |
| 3UTR-006 | G-CSF | GCCAAGCCCTCCCCATCCCATGTATTTATCTCT ATTTAATATTTATGTCTATTTAAGCCTCATATTT AAAGACAGGGAAGAGCAGAACGGAGCCCCAG GCCTCTGTGTCCTTCCCTGCATTTCTGAGTTTC ATTCTCCTGCCTGTAGCAGTGAGAAAAAGCTC CTGTCCTCCCATCCCCTGGACTGGGAGGTAGAT | 14 |

TABLE 7-continued

3'-Untranslated Regions

| 3' UTR Identifier | Name/ Description | Sequence | SEQ ID NO. |
|---|---|---|---|
| | | AGGTAAATACCAAGTATTTATTACTATGACTGC TCCCCAGCCCTGGCTCTGCAATGGGCACTGGG ATGAGCCGCTGTGAGCCCCTGGTCCTGAGGGT CCCCACCTGGGACCCTTGAGAGTATCAGGTCT CCCACGTGGGAGACAAGAAATCCCTGTTTAAT ATTTAAACAGCAGTGTTCCCCATCTGGGTCCTT GCACCCCTCACTCTGGCCTCAGCCGACTGCAC AGCGGCCCCTGCATCCCCTTGGCTGTGAGGCC CCTGGACAAGCAGAGGTGGCCAGAGCTGGGA GGCATGGCCCTGGGGTCCCACGAATTTGCTGG GGAATCTCGTTTTTCTTCTTAAGACTTTTGGGA CATGGTTTGACTCCCGAACATCACCGACGCGT CTCCTGTTTTTCTGGGTGGCCTCGGGACACCTG CCCTGCCCCCACGAGGGTCAGGACTGTGACTC TTTTTAGGGCCAGGCAGGTGCCTGGACATTTGC CTTGCTGGACGGGGACTGGGGATGTGGGAGGG AGCAGACAGGAGGAATCATGTCAGGCCTGTGT GTGAAAGGAAGCTCCACTGTCACCCTCCACCT CTTCACCCCCCACTCACCAGTGTCCCCTCCACT GTCACATTGTAACTGAACTTCAGGATAATAAA GTGTTTGCCTCCATGGTCTTTGAATAAAGCCTG AGTAGGAAGGCGGCCGCTCGAGCATGCATCTA GA | |
| 3UTR-007 | Col1a2; collagen, type I, alpha 2 | ACTCAATCTAAATTAAAAAAGAAAGAAATTTG AAAAAACTTTCTCTTTGCCATTTCTTCTTCTTCT TTTTTAACTGAAAGCTGAATCCTTCCATTTCTT CTGCACATCTACTTGCTTAAATTGTGGGCAAAA GAGAAAAAGAAGGATTGATCAGAGCATTGTGC AATACAGTTTCATTAACTCCTTCCCCCGCTCCC CCAAAAATTTGAATTTTTTTTTCAACACTCTTA CACCTGTTATGGAAAATGTCAACCTTTGTAAG AAAACCAAATAAAAATTGAAAAATAAAAAC CATAAACATTTGCACCACTTGTGGCTTTTGAAT ATCTTCCACAGAGGGAAGTTTAAAACCCAAAC TTCCAAAGGTTTAAACTACCTCAAAACACTTTC CCATGAGTGTGATCCACATTGTTAGGTGCTGAC CTAGACAGAGATGAACTGAGGTCCTTGTTTTGT TTTGTTCATAATACAAAGGTGCTAATTAATAGT ATTTCAGATACTTGAAGAATGTTGATGGTGCTA GAAGAATTTGAGAAGAAATACTCCTGTATTGA GTTGTATCGTGTGGTGTATTTTTTAAAAAATTT GATTTAGCATTCATATTTTCCATCTTATTCCCA ATTAAAAGTATGCAGATTATTTGCCCAAATCTT CTTCAGATTCAGCATTTGTTCTTTGCCAGTCTC ATTTTCATCTTCTTCCATGGTTCCACAGAAGCT TTGTTTCTTGGGCAAGCAGAAAAATTAAATTGT ACCTATTTTGTATATGTGAGATGTTTAAATAAA TTGTGAAAAAAATGAAATAAAGCATGTTTGGT TTTCCAAAAGAACATAT | 15 |
| 3UTR-008 | Col6a2; collagen, type VI, alpha 2 | CGCCGCCGCCCGGGCCCCGCAGTCGAGGGTCG TGAGCCCACCCCGTCCATGGTGCTAAGCGGGC CCGGGTCCCACACGGCCAGCACCGCTGCTCAC TCGGACGACGCCCTGGGCCTGCACCTCTCCAG CTCCTCCCACGGGGTCCCCGTAGCCCCGGCCC CCGCCCAGCCCCAGGTCTCCCCAGGCCCTCCG CAGGCTGCCCGGCCTCCCTCCCCCTGCAGCCAT CCCAAGGCTCCTGACCTACCTGGCCCCTGAGCT CTGGAGCAAGCCCTGACCCAATAAAGGCTTTG AACCCAT | 16 |
| 3UTR-009 | RPN1; ribophorin I | GGGGCTAGAGCCCTCTCCGCACAGCGTGGAGA CGGGGCAAGGAGGGGGGTTATTAGGATTGGTG GTTTTGTTTTGCTTTGTTTAAAGCCGTGGGAAA ATGGCACAACTTTACCTCTGTGGGAGATGCAA CACTGAGAGCCAAGGGGTGGGAGTTGGGATAA TTTTTATATAAAAGAAGTTTTTCCACTTTGAAT | 17 |

TABLE 7-continued

3'-Untranslated Regions

| 3' UTR Identifier | Name/ Description | Sequence | SEQ ID NO. |
|---|---|---|---|
| | | TGCTAAAAGTGGCATTTTTCCTATGTGCAGTCA<br>CTCCTCTCATTTCTAAAATAGGGACGTGGCCAG<br>GCACGGTGGCTCATGCCTGTAATCCCAGCACTT<br>TGGGAGGCCGAGGCAGGCGGCTCACGAGGTCA<br>GGAGATCGAGACTATCCTGGCTAACACGGTAA<br>AACCCTGTCTCTACTAAAAGTACAAAAAATTA<br>GCTGGGCGTGGTGGTGGGCACCTGTAGTCCCA<br>GCTACTCGGGAGGCTGAGGCAGGAGAAAGGC<br>ATGAATCCAAGAGGCAGAGCTTGCAGTGAGCT<br>GAGATCACGCCATTGCACTCCAGCCTGGGCAA<br>CAGTGTTAAGACTCTGTCTCAAATATAAATAA<br>ATAAATAAATAAATAAATAAATAAATAAAAAT<br>AAAGCGAGATGTTGCCCTCAAA | |
| 3UTR-010 | LRP1; low density lipoprotein receptor- related protein 1 | GGCCCTGCCCCGTCGGACTGCCCCCAGAAAGC<br>CTCCTGCCCCCTGCCAGTGAAGTCCTTCAGTGA<br>GCCCCTCCCCAGCCAGCCCTTCCCTGGCCCCGC<br>CGGATGTATAAATGTAAAAATGAAGGAATTAC<br>ATTTTATATGTGAGCGAGCAAGCCGGCAAGCG<br>AGCACAGTATTATTTCTCCATCCCCTCCCTGCC<br>TGCTCCTTGGCACCCCCATGCTGCCTTCAGGGA<br>GACAGGCAGGGAGGGCTTGGGGCTGCACCTCC<br>TACCCTCCCACCAGAACGCACCCCACTGGGAG<br>AGCTGGTGGTGCAGCCTTCCCCTCCCTGTATAA<br>GACACTTTGCCAAGGCTCTCCCCTCTCGCCCCA<br>TCCCTGCTTGCCCGCTCCCACAGCTTCCTGAGG<br>GCTAATTCTGGGAAGGGAGAGTTCTTTGCTGC<br>CCCTGTCTGGAAGACGTGGCTCTGGGTGAGGT<br>AGGCGGGAAAGGATGGAGTGTTTTAGTTCTTG<br>GGGGAGGCCACCCCAAACCCCAGCCCCAACTC<br>CAGGGGCACCTATGAGATGGCCATGCTCAACC<br>CCCCTCCCAGACAGGCCCTCCCTGTCTCCAGG<br>GCCCCCACCGAGGTTCCCAGGGCTGGAGACTT<br>CCTCTGGTAAACATTCCTCCAGCCTCCCCTCCC<br>CTGGGGACGCCAAGGAGGTGGGCCACACCCAG<br>GAAGGGAAAGCGGGCAGCCCCGTTTTGGGGAC<br>GTGAACGTTTTAATAATTTTTGCTGAATTCCTT<br>TACAACTAAATAACACAGATATTGTTATAAAT<br>AAAATTGT | 18 |
| 3UTR-011 | Nnt1; cardiotrophin- like cytokine factor 1 | ATATTAAGGATCAAGCTGTTAGCTAATAATGC<br>CACCTCTGCAGTTTTGGGAACAGGCAAATAAA<br>GTATCAGTATACATGGTGATGTACATCTGTAGC<br>AAAGCTCTTGGAGAAAATGAAGACTGAAGAA<br>AGCAAAGCAAAAACTGTATAGAGAGATTTTTC<br>AAAAGCAGTAATCCCTCAATTTTAAAAAAGGA<br>TTGAAAATTCTAAATGTCTTTCTGTGCATATTT<br>TTTGTGTTAGGAATCAAAAGTATTTTATAAAAG<br>GAGAAAGAACAGCCTCATTTTAGATGTAGTCC<br>TGTTGGATTTTTTATGCCTCCTCAGTAACCAGA<br>AATGTTTTAAAAAACTAAGTGTTTAGGATTTCA<br>AGACAACATTATACATGGCTCTGAAATATCTG<br>ACACAATGTAAACATTGCAGGCACCTGCATTT<br>TATGTTTTTTTTTCAACAAATGTGACTAATTT<br>GAAACTTTTATGAACTTCTGAGCTGTCCCCTTG<br>CAATTCAACCGCAGTTTGAATTAATCATATCAA<br>ATCAGTTTTAATTTTTTAAATTGTACTTCAGAG<br>TCTATATTTCAAGGGCACATTTTCTCACTACTA<br>TTTTAATACATTAAAGGACTAAATAATCTTTCA<br>GAGATGCTGGAAACAAATCATTTGCTTTATAT<br>GTTTCATTAGAATACCAATGAAACATACAACT<br>TGAAAATTAGTAATAGTATTTTTGAAGATCCCA<br>TTTCTAATTGGAGATCTCTTTAATTTCGATCAA<br>CTTATAATGTGTAGTACTATATTAAGTGCACTT<br>GAGTGGAATTCAACATTTGACTAATAAAATGA<br>GTTCATCATGTTGGCAAGTGATGTGGCAATTAT<br>CTCTGGTGACAAAAGAGTAAATCAAATATTT<br>CTGCCTGTTACAAATATCAAGGAAGACCTGCT<br>ACTATGAAATAGATGACATTAATCTGTCTTCAC<br>TGTTTATAATACGGATGGATTTTTTTCAAATC<br>AGTGTGTGTTTGAGGTCTTATGTAATTGATGA<br>CATTTGAGAGAAATGGTGGCTTTTTTTAGCTAC<br>CTCTTTGTTCATTTAAGCACCAGTAAAGATCAT<br>GTCTTTTTATAGAAGTGTAGATTTTCTTTGTGA | 19 |

TABLE 7-continued

3'-Untranslated Regions

| 3' UTR Identifier | Name/ Description | Sequence | SEQ ID NO. |
|---|---|---|---|
| | | CTTTGCTATCGTGCCTAAAGCTCTAAATATAGG TGAATGTGTGATGAATACTCAGATTATTTGTCT CTCTATATAATTAGTTTGGTACTAAGTTTCTCA AAAAATTATTAACACATGAAAGACAATCTCTA AACCAGAAAAAGAAGTAGTACAAATTTTGTTA CTGTAATGCTCGCGTTTAGTGAGTTTAAAACAC ACAGTATCTTTTGGTTTTATAATCAGTTTCTATT TTGCTGTGCCTGAGATTAAGATCTGTGTATGTG TGTGTGTGTGTGTGCGTTTGTGTGTTAAAGC AGAAAAGACTTTTTTAAAAGTTTTAAGTGATA AATGCAATTTGTTAATTGATCTTAGATCACTAG TAAACTCAGGGCTGAATTATACCATGTATATTC TATTAGAAGAAAGTAAACACCATCTTTATTCCT GCCCTTTTTCTTCTCTCAAAGTAGTTGTAGTTA TATCTAGAAAGAAGCAATTTTGATTTCTTGAAA AGGTAGTTCCTGCACTCAGTTTAAACTAAAAA TAATCATACTTGGATTTTATTTATTTTTGTCATA GTAAAAATTTTAATTTATATATATTTTTATTTA GTATTATCTTATTCTTTGCTATTTGCCAATCCTT TGTCATCAATTGTGTTAAATGAATTGAAAATTC ATGCCCTGTTCATTTTATTTTACTTTATTGGTTA GGATATTTAAAGGATTTTTGTATATATAATTTC TTAAATTAATATTCCAAAAGGTTAGTGGACTTA GATTATAAATTATGGCAAAAATCTAAAAACAA CAAAAATGATTTTTATACATTCTATTTCATTAT TCCTCTTTTTCCAATAAGTCATACAATTGGTAG ATATGACTTATTTTATTTTTGTATTATTCACTAT ATCTTTATGATATTTAAGTATAAATAATTAAAA AAATTTATTGTACCTTATAGTCTGTCACCAAAA AAAAAAAATTATCTGTAGGTAGTGAAATGCTA ATGTTGATTTGTCTTTAAGGGCTTGTTAACTAT CCTTTATTTTCTCATTTGTCTTAAATTAGGAGTT TGTGTTTAAATTACTCATCTAAGCAAAAAATGT ATATAAATCCCATTACTGGGTATATACCCAAA GGATTATAAATCATGCTGCTATAAAGACACAT GCACACGTATGTTTATTGCAGCACTATTCACAA TAGCAAAGACTTGGAACCAACCCAAATGTCCA TCAATGATAGACTTGATTAAGAAAATGTGCAC ATATACACCATGGAATACTATGCAGCCATAAA AAAGGATGAGTTCATGTCCTTTGTAGGGACAT GGATAAAGCTGGAAACCATCATTCTGAGCAAA CTATTGCAAGGACAGAAAACCAAACACTGCAT GTTCTCACTCATAGGTGGGAATTGAACAATGA GAACACTTGGACACAAGGTGGGGAACACCACA CACCAGGGCCTGTCATGGGGTGGGGGGAGTGG GGAGGGATAGCATTAGGAGATATACCTAATGT AAATGATGAGTTAATGGGTGCAGCACACCAAC ATGGCACATGTATACATATGTAGCAAACCTGC ACGTTGTGCACATGTACCCTAGAACTTAAAGT ATAATTAAAAAAAAAAGAAAACAGAAGCTA TTTATAAAGAAGTTATTTGCTGAAATAAATGTG ATCTTTCCCATTAAAAAAATAAAGAAATTTTG GGGTAAAAAAACACAATATATTGTATTCTTGA AAAATTCTAAGAGAGTGGATGTGAAGTGTTCT CACCACAAAAGTGATAACTAATTGAGGTAATG CACATATTAATTAGAAAGATTTTGTCATTCCAC AATGTATATATACTTAAAAATATGTTATACACA ATAAATACATACATTAAAAAATAAGTAAATGTA | |
| 3UTR-012 | Col6a1; collagen, type VI, alpha 1 | CCCACCCTGCACGCCGGCACCAAACCCTGTCC TCCCACCCCTCCCCACTCATCACTAAACAGAGT AAAATGTGATGCGAATTTTCCCGACCAACCTG ATTCGCTAGATTTTTTTAAGGAAAAGCTTGGA AAGCCAGGACACAACGCTGCTGCCTGCTTTGT GCAGGGTCCTCCGGGGCTCAGCCCTGAGTTGG CATCACCTGCGCAGGGCCCTCTGGGGCTCAGC CCTGAGCTAGTGTCACCTGCACAGGGCCCTCT GAGGCTCAGCCCTGAGCTGGCGTCACCTGTGC AGGGCCCTCTGGGGCTCAGCCCTGAGCTGGCC TCACCTGGGTTCCCCACCCCGGGCTCTCCTGCC CTGCCCTCCTGCCCGCCCTCCCTCCTGCCTGCG CAGCTCCTTCCCTAGGCACCTCTGTGCTGCATC CCACCAGCCTGAGCAAGACGCCCTCTCGGGGC CTGTGCCGCACTAGCCTCCCTCTCCTCTGTCCC | 20 |

TABLE 7-continued

3'-Untranslated Regions

| 3' UTR Identifier | Name/ Description | Sequence | SEQ ID NO. |
|---|---|---|---|
| | | CATAGCTGGTTTTTCCCACCAATCCTCACCTAA CAGTTACTTTACAATTAAACTCAAAGCAAGCT CTTCTCCTCAGCTTGGGGCAGCCATTGGCCTCT GTCTCGTTTTGGGAAACCAAGGTCAGGAGGCC GTTGCAGACATAAATCTCGGCGACTCGGCCCC GTCTCCTGAGGGTCCTGCTGGTGACCGGCCTG GACCTTGGCCCTACAGCCCTGGAGGCCGCTGC TGACCAGCACTGACCCCGACCTCAGAGAGTAC TCGCAGGGGCGCTGGCTGCACTCAAGACCCTC GAGATTAACGGTGCTAACCCCGTCTGCTCCTCC CTCCCGCAGAGACTGGGGCCTGGACTGGACAT GAGAGCCCCTTGGTGCCACAGAGGGCTGTGTC TTACTAGAAACAACGCAAACCTCTCCTTCCTCA GAATAGTGATGTGTTCGACGTTTTATCAAAGG CCCCCTTTCTATGTTCATGTTAGTTTTGCTCCTT CTGTGTTTTTTCTGAACCATATCCATGTTGCT GACTTTTCCAATAAAGGTTTTCACTCCTCTC | |
| 3UTR-013 | Calr; calreticulin | AGAGGCCTGCCTCCAGGGCTGGACTGAGGCCT GAGCGCTCCTGCCGCAGAGCTGGCCGCGCCAA ATAATGTCTCTGTGAGACTCGAGAACTTTCATT TTTTTCCAGGCTGGTTCGGATTTGGGGTGGATT TTGGTTTTGTTCCCCTCCTCCACTCTCCCCCACC CCCTCCCCGCCCTTTTTTTTTTTTTTTTAAAC TGGTATTTTATCTTTGATTCTCCTTCAGCCCTCA CCCCTGGTTCTCATCTTTCTTGATCAACATCTTT TCTTGCCTCTGTCCCCTTCTCTCATCTCTTAGCT CCCCTCCAACCTGGGGGGCAGTGGTGTGGAGA AGCCACAGGCCTGAGATTTCATCTGCTCTCCTT CCTGGAGCCCAGAGGAGGGCAGCAGAAGGGG GTGGTGTCTCCAACCCCCCAGCACTGAGGAAG AACGGGGCTCTTCTCATTTCACCCCTCCCTTTC TCCCCTGCCCCCAGGACTGGGCCACTTCTGGGT GGGGCAGTGGGTCCCAGATTGGCTCACACTGA GAATGTAAGAACTACAAACAAAATTTCTATTA AATTAAATTTTGTGTCTCC | 21 |
| 3UTR-014 | Col1a1; collagen, type I, alpha 1 | CTCCCTCCATCCCAACCTGGCTCCCTCCCACCC AACCAACTTTCCCCCCAACCCGGAAACAGACA AGCAACCCAAACTGAACCCCCTCAAAAGCCAA AAAATGGGAGACAATTTCACATGGACTTTGGA AAATATTTTTTTCCTTTGCATTCATCTCTCAAAC TTAGTTTTTATCTTTGACCAACCGAACATGACC AAAAACCAAAAGTGCATTCAACCTTACCAAAA AAAAAAAAAAAAAAAGAATAAATAAATAACT TTTTAAAAAAGGAAGCTTGGTCCACTTGCTTGA AGACCCATGCGGGGGTAAGTCCCTTTCTGCCC GTTGGGCTTATGAAACCCCAATGCTGCCCTTTC TGCTCCTTTCTCCACACCCCCCTTGGGGCCTCC CCTCCACTCCTTCCCAAATCTGTCTCCCCAGAA GACACAGGAAACAATGTATTGTCTGCCCAGCA ATCAAAGGCAATGCTCAAACACCCAAGTGGCC CCCACCCTCAGCCCGCTCCTGCCCGCCCAGCA CCCCCAGGCCCTGGGGGACCTGGGGTTCTCAG ACTGCCAAAGAAGCCTTGCCATCTGGCGCTCC CATGGCTCTTGCAACATCTCCCCTTCGTTTTTG AGGGGGTCATGCCGGGGAGCCACCAGCCCCT CACTGGGTTCGGAGGAGAGTCAGGAAGGGCCA CGACAAAGCAGAAACATCGGATTTGGGGAACG CGTGTCAATCCCTTGTGCCGCAGGGCTGGGCG GGAGAGACTGTTCTGTTCCTTGTGTAACTGTGT TGCTGAAAGACTACCTCGTTCTTGTCTTGATGT GTCACCGGGGCAACTGCCTGGGGCGGGGATG GGGGCAGGGTGGAAGCGGCTCCCCATTTTATA CCAAAGGTGCTACATCTATGTGATGGGTGGGG TGGGGAGGGAATCACTGGTGCTATAGAAATTG AGATGCCCCCCAGGCCAGCAAATGTTCCTTTT TGTTCAAAGTCTATTTTTATTCCTTGATATTTTT CTTTTTTTTTTTTTTTGTGGATGGGGACTT GTGAATTTTCTAAAGGTGCTATTTAACATGGG AGGAGAGCGTGTGCGGCTCCAGCCCAGCCCGC TGCTCACTTTCCACCCTCTCTCCACCTGCCTCT GGCTTCTCAGGCCTCTGCTCTCCGACCTCTCTC CTCTGAAACCCTCCTCCACAGCTGCAGCCCATC | 22 |

TABLE 7-continued

3'-Untranslated Regions

| 3' UTR Identifier | Name/ Description | Sequence | SEQ ID NO. |
|---|---|---|---|
| | | CTCCCGGCTCCCTCCTAGTCTGTCCTGCGTCCT CTGTCCCCGGGTTTCAGAGACAACTTCCCAAA GCACAAAGCAGTTTTTCCCCCTAGGGGTGGGA GGAAGCAAAAGACTCTGTACCTATTTTGTATGT GTATAATAATTTGAGATGTTTTTAATTATTTTG ATTGCTGGAATAAAGCATGTGGAAATGACCCA AACATAATCCGCAGTGGCCTCCTAATTTCCTTC TTTGGAGTTGGGGGAGGGGTAGACATGGGGAA GGGGCTTTGGGGTGATGGGCTTGCCTTCCATTC CTGCCCTTTCCCTCCCCACTATTCTCTTCTAGAT CCCTCCATAACCCCACTCCCCTTTCTCTCACCC TTCTTATACCGCAAACCTTTCTACTTCCTCTTTC ATTTTCTATTCTTGCAATTTCCTTGCACCTTTTC CAAATCCTCTTCTCCCCTGCAATACCATACAGG CAATCCACGTGCACAACACACACACACACTCT TCACATCTGGGGTTGTCCAAACCTCATACCCAC TCCCCTTCAAGCCCATCCACTCTCCACCCCCTG GATGCCCTGCACTTGGTGGCGGTGGGATGCTC ATGGATACTGGGAGGGTGAGGGGAGTGGAAC CCGTGAGGAGGACCTGGGGGCCTCTCCTTGAA CTGACATGAAGGGTCATCTGGCCTCTGCTCCCT TCTCACCCACGCTGACCTCCTGCCGAAGGAGC AACGCAACAGGAGAGGGGTCTGCTGAGCCTGG CGAGGGTCTGGGAGGGACCAGGAGGAAGGCG TGCTCCCTGCTCGCTGTCCTGGCCCTGGGGGAG TGAGGGAGACAGACACCTGGGAGAGCTGTGG GGAAGGCACTCGCACCGTGCTCTTGGGAAGGA AGGAGACCTGGCCCTGCTCACCACGGACTGGG TGCCTCGACCTCCTGAATCCCCAGAACACAAC CCCCCTGGGCTGGGTGGTCTGGGGAACCATC GTGCCCCGCCTCCCGCCTACTCCTTTTTAAGC TT | |
| 3UTR-015 | Plod1; procollagen- lysine, 2- oxoglutarate 5- dioxygenase 1 | TTGGCCAGGCCTGACCCTCTTGGACCTTTCTTC TTTGCCGACAACCACTGCCCAGCAGCCTCTGG GACCTCGGGGTCCCAGGGAACCCAGTCCAGCC TCCTGGCTGTTGACTTCCCATTGCTCTTGGAGC CACCAATCAAAGAGATTCAAAGAGATTCCTGC AGGCCAGAGGCGGAACACACCTTTATGGCTGG GGCTCTCCGTGGTGTTCTGGACCCAGCCCCTG AGACACCATTCACTTTTACTGCTTTGTAGTGAC TCGTGCTCTCCAACCTGTCTTCCTGAAAAACCA AGGCCCCCTTCCCCCACCTCTTCCATGGGGTGA GACTTGAGCAGAACAGGGGCTTCCCCAAGTTG CCCAGAAAGACTGTCTGGGTGAGAAGCCATGG CCAGAGCTTCTCCCAGGCACAGGTGTTGCACC AGGGACTTCTGCTTCAAGTTTTGGGGTAAAGA CACCTGGATCAGACTCCAAGGGCTGCCCTGAG TCTGGGACTTCTGCCTCCATGGCTGGTCATGAG AGCAAACCGTAGTCCCCTGGAGACAGCGACTC CAGAGAACCTCTTGGGAGACAGAAGAGGCATC TGTGCACAGCTCGATCTTCTACTTGCCTGTGGG GAGGGGAGTGACAGGTCCACACACCACACTGG GTCACCCTGTCCTGGATGCCTCTGAAGAGAGG GACAGACCGTCAGAAACTGGAGAGTTTCTATT AAAGGTCATTTAAACCA | 23 |
| 3UTR-016 | Nucb1; nucleobindin 1 | TCCTCCGGGACCCCAGCCCTCAGGATTCCTGAT GCTCCAAGGCGACTGATGGGCGCTGGATGAAG TGGCACAGTCAGCTTCCCTGGGGGCTGGTGTC ATGTTGGGCTCCTGGGGCGGGGGCACGGCCTG GCATTTCACGCATTGCTGCCACCCCAGGTCCAC CTGTCTCCACTTTCACAGCCTCCAAGTCTGTGG CTCTTCCCTTCTGTCCTCCGAGGGGCTTGCCTT CTCTCGTGTCCAGTGAGGTGCTCAGTGATCGGC TTAACTTAGAGAAGCCCGCCCCCTCCCCTTCTC CGTCTGTCCCAAGAGGGTCTGCTCTGAGCCTGC GTTCCTAGGTGGCTCGGCCTCAGCTGCCTGGGT TGTGGCCGCCCTAGCATCCTGTATGCCCACAGC TACTGGAATCCCCGCTGCTGCTCCGGGCCAAG CTTCTGGTTGATTAATGAGGGCATGGGGTGGT CCCTCAAGACCTTCCCCTACCTTTTGTGGAACC AGTGATGCCTCAAAGACAGTGTCCCCTCCACA GCTGGGTGCCAGGGGCAGGGGATCCTCAGTAT | 24 |

TABLE 7-continued

3'-Untranslated Regions

| 3' UTR Identifier | Name/ Description | Sequence | SEQ ID NO. |
|---|---|---|---|
| | | AGCCGGTGAACCCTGATACCAGGAGCCTGGGC CTCCCTGAACCCCTGGCTTCCAGCCATCTCATC GCCAGCCTCCTCCTGGACCTCTTGGCCCCCAGC CCCTTCCCCACACAGCCCCAGAAGGGTCCCAG AGCTGACCCCACTCCAGGACCTAGGCCCAGCC CCTCAGCCTCATCTGGAGCCCCTGAAGACCAG TCCCACCCACCTTTCTGGCCTCATCTGACACTG CTCCGCATCCTGCTGTGTGTCCTGTTCCATGTT CCGGTTCCATCCAAATACACTTTCTGGAACAAA | |
| 3UTR-017 | α-globin | GCTGGAGCCTCGGTGGCCATGCTTCTTGCCCCT TGGGCCTCCCCCCAGCCCCTCCTCCCCTTCCTG CACCCGTACCCCCGTGGTCTTTGAATAAAGTCT GAGTGGGCGGC | 25 |

It should be understood that those listed in the previous tables are examples and that any UTR from any gene may be incorporated into the respective first or second flanking region of the primary construct. Furthermore, multiple wild-type UTRs of any known gene may be utilized. It is also within the scope of the present invention to provide artificial UTRs which are not variants of wild type genes. These UTRs or portions thereof may be placed in the same orientation as in the transcript from which they were selected or may be altered in orientation or location. Hence a 5' or 3' UTR may be inverted, shortened, lengthened, made chimeric with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, polypeptides of interest may belong to a family of proteins which are expressed in a particular cell, tissue or at some time during development. The UTRs from any of these genes may be swapped for any other UTR of the same or different family of proteins to create a new chimeric primary transcript. As used herein, a "family of proteins" is used in the broadest sense to refer to a group of two or more polypeptides of interest which share at least one function, structure, feature, localization, origin, or expression pattern.

After optimization (if desired), the primary construct components are reconstituted and transformed into a vector such as, but not limited to, plasmids, viruses, cosmids, and artificial chromosomes. For example, the optimized construct may be reconstituted and transformed into chemically competent E. coli, yeast, neurospora, maize, drosophila, etc. where high copy plasmid-like or chromosome structures occur by methods described herein. Stop Codons In one embodiment, the primary constructs of the present invention may include at least two stop codons before the 3' untranslated region (UTR). The stop codon may be selected from TGA, TAA and TAG. In one embodiment, the primary constructs of the present invention include the stop codon TGA and one additional stop codon. In a further embodiment the addition stop codon may be TAA.
Vector Amplification The vector containing the primary construct is then amplified and the plasmid isolated and purified using methods known in the art such as, but not limited to, a maxi prep using the Invitrogen PURELINK™ HiPure Maxiprep Kit (Carlsbad, Calif.).
Plasmid Linearization The plasmid may then be linearized using methods known in the art such as, but not limited to, the use of restriction enzymes and buffers. The linearization reaction may be purified using methods including, for example Invitrogen's PURELINK™ PCR Micro Kit (Carlsbad, Calif.), and HPLC based purification methods such as, but not limited to, strong anion exchange HPLC, weak anion exchange HPLC, reverse phase HPLC (RP-HPLC), and hydrophobic interaction HPLC (HIC-HPLC) and Invitrogen's standard PURELINK™ PCR Kit (Carlsbad, Calif.). The purification method may be modified depending on the size of the linearization reaction which was conducted. The linearized plasmid is then used to generate cDNA for in vitro transcription (IVT) reactions.
cDNA Template Synthesis A cDNA template may be synthesized by having a linearized plasmid undergo polymerase chain reaction (PCR). Table 8 is a listing of primers and probes that may be useful in the PCR reactions of the present invention. It should be understood that the listing is not exhaustive and that primer-probe design for any amplification is within the skill of those in the art. Probes may also contain chemically modified bases to increase base-pairing fidelity to the target molecule and base-pairing strength. Such modifications may include 5-methyl-Cytidine, 2,6-di-amino-purine, 2'-fluoro, phosphoro-thioate, or locked nucleic acids.

TABLE 8

Primers and Probes

| Primer/ Probe Identifier | Sequence (5'-3') | Hybridization target | SEQ ID NO. |
|---|---|---|---|
| UFP | TTGGACCCTCGTACAGAAGCTAATACG | cDNA Template | 26 |
| URP | $T_{x160}$CTTCCTACTCAGGCTTTATTCAAAGACCA | cDNA Template | 27 |
| GBA1 | CCTTGACCTTCTGGAACTTC | Acid glucocerebrosidase | 28 |
| GBA2 | CCAAGCACTGAAACGGATAT | Acid glucocerebrosidase | 29 |
| LUC1 | GATGAAAAGTGCTCCAAGGA | Luciferase | 30 |
| LUC2 | AACCGTGATGAAAAGGTACC | Luciferase | 31 |
| LUC3 | TCATGCAGATTGGAAAGGTC | Luciferase | 32 |
| GCSF1 | CTTCTTGGACTGTCCAGAGG | G-CSF | 33 |
| GCSF2 | GCAGTCCCTGATACAAGAAC | G-CSF | 34 |
| GCSF3 | GATTGAAGGTGGCTCGCTAC | G-CSF | 35 |

*UFP is universal forward primer; URP is universal reverse primer.

In one embodiment, the cDNA may be submitted for sequencing analysis before undergoing transcription.

Polynucleotide Production

The process of polynucleotide production may include, but is not limited to, in vitro transcription, cDNA template removal and RNA clean-up, and capping and/or tailing reactions.

In Vitro Transcription

The cDNA produced in the previous step may be transcribed using an in vitro transcription (IVT) system. The system typically comprises a transcription buffer, nucleotide triphosphates (NTPs), an RNase inhibitor and a polymerase. The NTPs may be manufactured in house, may be selected from a supplier, or may be synthesized as described herein. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to be incorporated into modified nucleic acids.

RNA Polymerases

Any number of RNA polymerases or variants may be used in the design of the primary constructs of the present invention.

RNA polymerases may be modified by inserting or deleting amino acids of the RNA polymerase sequence. As a non-limiting example, the RNA polymerase may be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants may be obtained by evolving an RNA polymerase, optimizing the RNA polymerase amino acid and/or nucleic acid sequence and/or by using other methods known in the art. As a non-limiting example, T7 RNA polymerase variants may be evolved using the continuous directed evolution system set out by Esvelt et al. (Nature (2011) 472(7344):499-503; herein incorporated by reference in its entirety) where clones of T7 RNA polymerase may encode at least one mutation such as, but not limited to, lysine at position 93 substituted for threonine (K93T), 14M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants may encode at least mutation as described in U.S. Pub. Nos. 20100120024 and 20070117112; herein incorporated by reference in their entireties. Variants of RNA polymerase may also include, but are not limited to, substitutional variants, conservative amino acid substitution, insertional variants, deletional variants and/or covalent derivatives.

In one embodiment, the primary construct may be designed to be recognized by the wild type or variant RNA polymerases. In doing so, primary construct may be modified to contain sites or regions of sequence changes from the wild type or parent primary construct.

In one embodiment, the primary construct may be designed to include at least one substitution and/or insertion upstream of an RNA polymerase binding or recognition site, downstream of the RNA polymerase binding or recognition site, upstream of the TATA box sequence, downstream of the TATA box sequence of the primary construct but upstream of the coding region of the primary construct, within the 5'UTR, before the 5'UTR and/or after the 5'UTR.

In one embodiment, the 5'UTR of the primary construct may be replaced by the insertion of at least one region and/or string of nucleotides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the primary construct may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the primary construct may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleic acid may cause a silent mutation of the nucleic acid sequence or may cause a mutation in the amino acid sequence.

In one embodiment, the primary construct may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the primary construct may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the primary construct may include at least one substitution and/or insertion upstream of the start codon. For the purpose of clarity, one of skill in the art would appreciate that the start codon is the first codon of the protein coding region whereas the transcription start site is the site where transcription begins. The primary construct may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the primary construct may be substituted with adenine, cytosine, thymine, or any of the nucleotides described herein. In another non-limiting example the substitution of guanine bases in the primary construct may be designed so as to leave one guanine base in the region downstream of the transcription start site and before the start codon (see Esvelt et al. Nature (2011) 472(7344):499-503; herein incorporated by reference in its entirety). As a non-limiting example, at least 5 nucleotides may be inserted at 1 location downstream of the transcription start site but upstream of the start codon and the at least 5 nucleotides may be the same base type.

cDNA Template Removal and Clean-Up

The cDNA template may be removed using methods known in the art such as, but not limited to, treatment with Deoxyribonuclease I (DNase I). RNA clean-up may also include a purification method such as, but not limited to, AGENCOURT® CLEANSEQ® system from Beckman Coulter (Danvers, Mass.), HPLC based purification methods such as, but not limited to, strong anion exchange HPLC, weak anion exchange HPLC, reverse phase HPLC (RP-HPLC), and hydrophobic interaction HPLC (HIC-HPLC).

Capping and/or Tailing Reactions

The primary construct or mmRNA may also undergo capping and/or tailing reactions. A capping reaction may be performed by methods known in the art to add a 5' cap to the 5' end of the primary construct. Methods for capping include, but are not limited to, using a Vaccinia Capping enzyme (New England Biolabs, Ipswich, Mass.).

A poly-A tailing reaction may be performed by methods known in the art, such as, but not limited to, 2' O-methyltransferase and by methods as described herein. If the primary construct generated from cDNA does not include a poly-T, it may be beneficial to perform the poly-A-tailing reaction before the primary construct is cleaned.

Purification

The primary construct or mmRNA purification may include, but is not limited to, mRNA or mmRNA clean-up, quality assurance and quality control. mRNA or mmRNA clean-up may be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified mRNA or mmRNA" refers to one that is separated from at least one contaminant. As used herein, a "contaminant" is any substance which makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the mRNA or mmRNA may be sequenced by methods including, but not limited to reverse-transcriptase-PCR.

In one embodiment, the mRNA or mmRNA may be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified mRNA or mmRNA may be analyzed in order to determine if the mRNA or mmRNA may be of proper size, check that no degradation of the mRNA or mmRNA has occurred. Degradation of the mRNA and/or mmRNA may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Signal Peptides or Proteins

The primary constructs or mmRNA may also encode additional features which facilitate trafficking of the polypeptides to therapeutically relevant sites. One such feature which aids in protein trafficking is the signal peptide sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded polypeptide to the endoplasmic reticulum through one or more secretory pathways. Some signal peptides are cleaved from the protein by signal peptidase after the proteins are transported.

Table 9 is a representative listing of signal proteins or peptides which may be incorporated for encoding by the polynucleotides, primary constructs or mmRNA of the invention.

TABLE 9

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-001 | α-1-antitrypsin | ATGATGCCATCCTCAGTCTCA TGGGGTATTTTGCTCTTGGCG GGTCTGTGCTGTCTCGTGCCG GTGTCGCTCGCA | 36 | MMPSSVSW GILLAGLCC LVPVSLA | 98 |
| SS-002 | G-CSF | ATGGCCGGACCGGCGACTCAG TCGCCCATGAAACTCATGGCC CTGCAGTTGTTGCTTTGGCAC TCAGCCCTCTGGACCGTCCAA GAGGCG | 37 | MAGPATQS PMKLMALQ LLLWHSAL WTVQEA | 99 |
| SS-003 | Factor IX | ATGCAGAGAGTGAACATGATT ATGGCCGAGTCCCCATCGCTC ATCACAATCTGCCTGCTTGGT ACCTGCTTTCCGCCGAATGCA CTGTCTTTCTGGATCACGAGA ATGCGAATAAGATCTTGAACC GACCCAAACGG | 38 | MQRVNMIM AESPSLITIC LLGYLLSAE CTVFLDHEN ANKILNRPKR | 100 |
| SS-004 | Prolactin | ATGAAAGGATCATTGCTGTTG CTCCTCGTGTCGAACCTTCTG CTTTGCCAGTCCGTAGCCCCC | 39 | MKGSLLLLL VSNLLLCQS VAP | 101 |
| SS-005 | Albumin | ATGAAATGGGTGACGTTCATC TCACTGTTGTTTTTGTTCTCGT CCGCCTACTCCAGGGGAGTAT TCCGCCGA | 40 | MKWVTFISL LFLFSSAYS RG VFRR | 102 |
| SS-006 | HMMSP38 | ATGTGGTGGCGGCTCTGGTGG CTGCTCCTGTTGCTCCTCTTGC TGTGGCCCATGGTGTGGGCA | 41 | MWWRLWW LLLLLLLLP MWA | 103 |
| MLS-001 | ornithine carbamoyltransferase | TGCTCTTTAACCTCCGCATCCT GTTGAATAACGCTGCGTTCCG AAATGGGCATAACTTCATGGT ACGCAACTTCAGATGCGGCCA GCCACTCCAG | 42 | MLFNLRILL NNAAFRNG HNFMVRNF RCGQPLQ | 104 |
| MLS-002 | Cytochrome C Oxidase subunit 8A | ATGTCCGTCTTGACACCCCTG CTCTTGAGAGGGCTGACGGGG TCCGCTAGACGCCTGCCGGTA CCGCGAGCGAAGATCCACTCC CTG | 43 | MSVLTPLLL RGLTGSARR LPVPRAKIH SL | 105 |
| MLS-003 | Cytochrome C Oxidase subunit 8A | ATGAGCGTGCTCACTCCGTTG CTTCTTCGAGGGCTTACGGGA TCGGCTCGGAGGTTGCCCGTC CCGAGAGCGAAGATCCATTCG TTG | 44 | MSVLTPLLL RGLTGSARR LPVPRAKIH SL | 106 |

TABLE 9-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-007 | Type III, bacterial | TGACAAAAATAACTTTATCTC CCCAGAATTTTAGAATCCAAA AACAGGAAACCACACTACTA AAAGAAAAATCAACCGAGAA AAATTCTTTAGCAAAAAGTAT TCTCGCAGTAAAAATCACTTC ATCGAATTAAGGTCAAAATTA TCGGAACGTTTTATTTCGCAT AAGAACACT | 45 | MVTKITLSP QNFRIQKQE TTLLKEKST EKNSLAKSI LAVKNHFIE LRSKLSERFI SHKNT | 107 |
| SS-008 | Viral | ATGCTGAGCTTTGTGGATACC CGCACCCTGCTGCTGCTGGCG GTGACCAGCTGCCTGGCGACC TGCCAG | 46 | MLSFVDTRT LLLLAVTSC LATCQ | 108 |
| SS-009 | viral | ATGGGCAGCAGCCAGGCGCC GCGCATGGGCAGCGTGGGCG GCCATGGCCTGATGGCGCTGC TGATGGCGGGCCTGATTCTGC CGGGCATTCTGGCG | 47 | MGSSQAPR MGSVGGHG LMALLMAG LILPGILA | 109 |
| SS-010 | Viral | ATGGCGGGCATTTTTTATTTTC TGTTTAGCTTTCTGTTTGGCAT TTGCGAT | 48 | MAGIFYFLF SFLFGICD | 110 |
| SS-011 | Viral | ATGGAAAACCGCCTGCTGCGC GTGTTTCTGGTGTGGGCGGCG CTGACCATGGATGGCGCGAGC GCG | 49 | MENRLLRV FLVWAALT MDGASA | 111 |
| SS-012 | Viral | ATGGCGCGCCAGGGCTGCTTT GGCAGCTATCAGGTGATTAGC CTGTTTACCTTTGCGATTGGC GTGAACCTGTGCCTGGGC | 50 | MARQGCFG SYQVISLFTF AIGVNLCLG | 112 |
| SS-013 | Bacillus | ATGAGCCGCCTGCCGGTGCTG CTGCTGCTGCAGCTGCTGGTG CGCCCGGGCCTGCAG | 51 | MSRLPVLLL LQLLVRPGLQ | 113 |
| SS-014 | Bacillus | ATGAAACAGCAGAAACGCCT GTATGCGCGCCTGCTGACCCT GCTGTTTGCGCTGATTTTTCTG CTGCCGCATAGCAGCGCGAGC GCG | 52 | MKQQKRLY ARLLTLLFA LIFLLPHSSA SA | 114 |
| SS-015 | Secretion signal | ATGGCGACGCCGCTGCCTCCG CCCTCCCCGCGGCACCTGCGG CTGCTGCGGCTGCTGCTCTCC GCCCTCGTCCTCGGC | 53 | MATPLPPPS PRHLRLLRL LLSG | 115 |
| SS-016 | Secretion signal | ATGAAGGCTCCGGGTCGGCTC GTGCTCATCATCCTGTGCTCC GTGGTCTTCTCT | 54 | MKAPGRLV LIILCSVVFS | 116 |
| SS-017 | Secretion signal | ATGCTTCAGCTTTGGAAACTT GTTCTCCTGTGCGGCGTGCTC ACT | 55 | MLQLWKLL CGVLT | 117 |
| SS-018 | Secretion signal | ATGCTTTATCTCCAGGGTTGG AGCATGCCTGCTGTGGCA | 56 | MLYLQGWS MPAVA | 118 |
| SS-019 | Secretion signal | ATGGATAACGTGCAGCCGAA AATAAAACATCGCCCCTTCTG CTTCAGTGTGAAAGGCCACGT GAAGATGCTGCGGCTGGATAT TATCAACTCACTGGTAACAAC AGTATTCATGCTCATCGTATC TGTGTTGGCACTGATACCA | 57 | MDNVQPKI KHRPFCFSV KGHVKMLR LDIINSLVTT VFMLIVSVL ALIP | 119 |
| SS-020 | Secretion signal | ATGCCCTGCCTAGACCAACAG CTCACTGTTCATGCCCTACCCT GCCCTGCCCAGCCCTCCTCTC TGGCCTTCTGCCAAGTGGGGT TCTTAACAGCA | 58 | MPCLDQQL TVHALPCPA QPSSLAFCQ VGFLTA | 120 |

TABLE 9-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-021 | Secretion signal | ATGAAAACCTTGTTCAATCCA GCCCCTGCCATTGCTGACCTG GATCCCCAGTTCTACACCCTC TCAGATGTGTTCTGCTGCAAT GAAAGTGAGGCTGAGATTTTA ACTGGCCTCACGGTGGGCAGC GCTGCAGATGCT | 59 | MKTLFNPAP AIADLDPQF YTLSDVFCC NESEAEILT GLTVGSAA DA | 121 |
| SS-022 | Secretion signal | ATGAAGCCTCTCCTTGTTGTG TTTGTCTTTCTTTTCCTTTGGG ATCCAGTGCTGGCA | 60 | MKPLLVVF VFLFLWDPV LA | 122 |
| SS-023 | Secretion signal | ATGTCCTGTTCCCTAAAGTTT ACTTTGATTGTAATTTTTTTTT ACTGTTGGCTTTCATCCAGC | 61 | MSCSLKFTL IVIFFTCTLS SS | 123 |
| SS-024 | Secretion signal | ATGGTTCTTACTAAACCTCTTC AAAGAAATGGCAGCATGATG AGCTTTGAAAATGTGAAAGAA AAGAGCAGAGAAGGAGGCC CCATGCACACACACCCGAAGA AGAATTGTGTTTCGTGGTAAC ACACTACCCTCAGGTTCAGAC CACACTCAACCTGTTTTTCCAT ATATTCAAGGTTCTTACTCAA CCACTTTCCCTTCTGTGGGGT | 62 | MVLTKPLQ RNGSMMSF ENVKEKSRE GGPHAHTPE EELCFVVTH TPQVQTTLN LFFHIFKVLT QPLSLLWG | 124 |
| SS-025 | Secretion signal | ATGGCCACCCCGCCATTCCGG CTGATAAGGAAGATGTTTTCC TTCAAGGTGAGCAGATGGATG GGGCTTGCCTGCTTCCGGTCC CTGGCGGCATCC | 63 | MATPPFRLI RKMFSFKVS RWMGLACF RSLAAS | 125 |
| SS-026 | Secretion signal | ATGAGCTTTTTCCAACTCCTG ATGAAAAGGAAGGAACTCAT TCCCTTGGTGGTGTTCATGAC TGTGGCGGCGGGTGGAGCCTC ATCT | 64 | MSFFQLLM KRKELIPLV VFMTVAAG GASS | 126 |
| SS-027 | Secretion signal | ATGGTCTCAGCTCTGCGGGGA GCACCCCTGATCAGGGTGCAC TCAAGCCCTGTTTCTTCTCCTT CTGTGAGTGGACCACGGAGGC TGGTGAGCTGCCTGTCATCCC AAAGCTCAGCTCTGAGC | 65 | MVSALRGA PLIRVHSSPV SSPSVSGPA ALVSCLSSQ SSALS | 127 |
| SS-028 | Secretion signal | ATGATGGGGTCCCCAGTGAGT CATCTGCTGGCCGGCTTCTGT GTGTGGGTCGTCTTGGGC | 66 | MMGSPVSH LLAGFCVW VVLG | 128 |
| SS-029 | Secretion signal | ATGGCAAGCATGGCTGCCGTG CTCACCTGGGCTCTGGCTCTT CTTTCAGCGTTTTCGGCCACC CAGGCA | 67 | MASMAAVL TWALALLS AFSATQA | 129 |
| SS-030 | Secretion signal | ATGGTGCTCATGTGGACCAGT GGTGACGCCTTCAAGACGGCC TACTTCCTGCTGAAGGGTGCC CCTCTGCAGTTCTCCGTGTGC GGCCTGCTGCAGGTGCTGGTG GACCTGGCCATCCTGGGGCAG GCCTACGCC | 68 | MVLMWTSG DAFKTAYFL LKGAPLQFS VCGLLQVL VDLAILGQA TA | 130 |
| SS-031 | Secretion signal | ATGGATTTTGTCGCTGGAGCC ATCGGAGGCGTCTGCGGTGTT GCTGTGGGCTACCCCCTGGAC ACGGTGAAGGTCAGGATCCA GACGGAGCCAAAGTACACAG GCATCTGGCACTGCGTCGGG ATACGTATCACCGAGAGCGCG TGTGGG GCTTCTACCGGGGCCTCTCGC TGCCCGTGTGCACGGTGTCCC TGGTATCTTCC | 69 | MDFVAGAI GGVCGVAV GYPLDTVK VRIQTEPLY TGIWHCVR DTYHRERV WGFYRGLS LPVCTVSLV SS | 131 |

TABLE 9-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-032 | Secretion signal | ATGGAGAAGCCCCTCTTCCCA TTAGTGCCTTTGCATTGGTTTG GCTTTGGCTACACAGCACTGG TTGTTTCTGGTGGGATCGTTG GCTATGTAAAAACAGGCAGC GTGCCGTCCCTGGCTGCAGGG CTGCTCTTCGGCAGTCTAGCC | 70 | MEKPLFPLV PLHWFGFG YTALVVSG GIVGYVKTG SVPSLAAGL LFGSLA | 132 |
| SS-033 | Secretion signal | ATGGGTCTGCTCCTTCCCCTG GCACTCTGCATCCTAGTCCTG TGC | 71 | MGLLLPLAL CILVLC | 133 |
| SS-034 | Secretion signal | ATGGGGATCCAGACGAGCCCC GTCCTGCTGGCCTCCCTGGGG GTGGGGCTGGTCACTCTGCTC GGCCTGGCTGTGGGC | 72 | MGIQTSPVL LASLGVGLV TLLGLAVG | 134 |
| SS-035 | Secretion signal | ATGTCGGACCTGCTACTACTG GGCCTGATTGGGGGCCTGACT CTCTTACTGCTGCTGACGCTG CTAGCCTTTGCC | 73 | MSDLLLLGL IGGLTLLLL LTLLAFA | 135 |
| SS-036 | Secretion signal | ATGGAGACTGTGGTGATTGTT GCCATAGGTGTGCTGGCCACC ATGTTTCTGGCTTCGTTTGCAG CCTTGGTGCTGGTTTGCAGGC AG | 74 | METVVIVAI GVLATIFLA SFAALVLVC RQ | 136 |
| SS-037 | Secretion signal | ATGGCGGCTCTGTGGAGTGC ACCTGGGGTTGGGGGCACTGT GCCCCCAGCCCCCTGCTCCTT TGGACTCTACTTCTGTTTGCA GCCCCATTTGGCCTGCTGGGG | 75 | MAGSVECT WGWGHCAP SPLLLWTLL LFAAPFGLLG | 137 |
| SS-038 | Secretion signal | ATGATGCCGTCCCGTACCAAC CTGGCTACTGGAATCCCCAGT AGTAAAGTGAAATATTCAAGG CTCTCCAGCACAGACGATGGC TACATTGACCTTCAGTTTAAG AAAACCCCTCCTAAGATCCCT TATAAGGCCATCGCACTTGCC ACTGTGCTGTTTTTGATTGGC GCC | 76 | MMPSRTNL ATGIPSSKV KYSRLSSTD DGYIDLQFK KTPPKIPYK AIALATVLF LIGA | 138 |
| SS-039 | Secretion signal | ATGGCCCTGCCCCAGATGTGT GACGGGAGCCACTTGGCCTCC ACCCTCCGCTATTGCATGACA GTCAGCGGCACAGTGGTTCTG GTGGCCGGGACGCTCTGCTTC GCT | 77 | MALPQMCD GSHLASTLR YCMTVSGT VVLVAGTL CFA | 139 |
| SS-041 | Vrg-6 | TGAAAAAGTGGTTCGTTGCTG CCGGCATCGGCGCTGCCGGAC TCATGCTCTCCAGCGCCGCCA | 78 | MKKWFVAA GIGAGLLML SSAA | 140 |
| SS-042 | PhoA | ATGAAACAGAGCACCATTGCG CTGGCGCTGCTGCCGCTGCTG TTTACCCCGGTGACCAAAGCG | 79 | MKQSTIALA LLPLLFTPV TKA | 141 |
| SS-043 | OmpA | ATGAAAAAAACCGCGATTGCG GATTGCGGTGGCGCTGGCGGG CTTTGCGACCGTGGCGCAGGCG | 80 | MKKTAIAIA VALAGFAT VAQA | 142 |
| SS-044 | STI | ATGAAAAAACTGATGCTGGCG ATTTTTTTTAGCGTGCTGAGCT TTCCGAGCTTTAGCCAGAGC | 81 | MKKLMLAI FFSVLSFPSF SQS | 143 |
| SS-045 | STII | ATGAAAAAAAACATTGCGTTT CTGCTGGCAGCATGTTTGTG TTTAGCATTGCGACCAACGCG TATGCG | 82 | MKKNIAFLL ASMFVFSIA TNAYA | 144 |

TABLE 9-continued

Signal Peptides

| ID | Description | NUCLEOTIDE SEQUENCE (5'-3') | SEQ ID NO. | ENCODED PEPTIDE | SEQ ID NO. |
|---|---|---|---|---|---|
| SS-046 | Amylase | ATGTTTGCGAAACGCTTTAAA ACCAGCCTGCTGCCGCTGTTT GCGGGCTTTCTGCTGCTGTTTC ATCTGGTGCTGGCGGGCCCGG CGGCGGCGAGC | 83 | MFAKRFKTS LLPLFAGFL LLFHLVLAG PAAAS | 145 |
| SS-047 | Alpha Factor | ATGCGCTTTCCGAGCATTTTT ACCGCGGTGCTGTTTGCGGCG AGCAGCGCGCTGGCG | 84 | MRFPSIFTA VLFAASSALA | 146 |
| SS-048 | Alpha Factor | ATGCGCTTTCCGAGCATTTTT ACCACCGTGCTGTTTGCGGCG AGCAGCGCGCTGGCG | 85 | MRFPSIFTT VLFAASSALA | 147 |
| SS-049 | Alpha Factor | ATGCGCTTTCCGAGCATTTTT ACCAGCGTGCTGTTTGCGGCG AGCAGCGCGCTGGCG | 86 | MRFPSIFTSV LFAASSALA | 148 |
| SS-050 | Alpha Factor | ATGCGCTTTCCGAGCATTTTT ACCCATGTGCTGTTTGCGGCG AGCAGCGCGCTGGCG | 87 | MRFPSIFTH VLFAASSALA | 149 |
| SS-051 | Alpha Factor | ATGCGCTTTCCGAGCATTTTT ACCATTGTGCTGTTTGCGGCG AGCAGCGCGCTGGCG | 88 | MRFPSIFTIV LFAASSALA | 150 |
| SS-052 | Alpha Factor | ATGCGCTTTCCGAGCATTTTT ACCTTTGTGCTGTTTGCGGCG AGCAGCGCGCTGGCG | 89 | MRFPSIFTFV LFAASSALA | 151 |
| SS-053 | Alpha Factor | ATGCGCTTTCCGAGCATTTTT ACCGAAGTGCTGTTTGCGGCG AGCAGCGCGCTGGCG | 90 | MRFPSIFTE VLFAASSALA | 152 |
| SS-054 | Alpha Factor | ATGCGCTTTCCGAGCATTTTT ACCGGCGTGCTGTTTGCGGCG AGCAGCGCGCTGGCG | 91 | MRFPSIFTG VLFAASSALA | 153 |
| SS-055 | Endoglucanase V | ATGCGTTCCTCCCCCCTCCTCC GCTCCGCCGTTGTGGCCGCCC TGCCGGTGTTGGCCCTTGCC | 92 | MRSSPLLRS AVVAALPV LALA | 154 |
| SS-056 | Secretion signal | ATGGGCGCGGCGGCCGTGCGC TGGCACTTGTGCGTGCTGCTG GCCCTGGGCACACGCGGGCG GCTG | 93 | MGAAAVR WHLCVLLA LGTRGRL | 155 |
| SS-057 | Fungal | ATGAGGAGCTCCCTTGTGCTG TTCTTTGTCTCTGCGTGGACG GCCTTGGCCAG | 94 | MRSSLVLFF VSAWTALA | 156 |
| SS-058 | Fibronectin | ATGCTCAGGGGTCCGGGACCC GGGCGGCTGCTGCTGCTAGCA GTCCTGTGCCTGGGGACATCG GTGCGCTGCACCGAAACCGGG AAGAGCAAGAGG | 95 | MLRGPGPG RLLLLAVLC LGTSVRCTE TGKSKR | 157 |
| SS-059 | Fibronectin | ATGCTTAGGGGTCCGGGGCCC GGGCTGCTGCTGCTGGCCGTC CAGCTGGGGACAGCGGTGCCC TCCACG | 96 | MLRGPGPG LLLLAVQCL GTAVPSTGA | 158 |
| SS-060 | Fibronectin | ATGCGCCGGGGGCCCTGACC GGGCTGCTCCTGGTCCTGTGC CTGAGTGTTGTGCTACGTGCA GCCCCTCTGCAACAAGCAAG AAGCGCAGG | 97 | MRRGALTG LLLVLCLSV VLRAAPSAT SKKRR | 159 |

In table 9, SS is secretion signal and MLS is mitochondrial leader signal. The primary constructs or mmRNA of the present invention may be designed to encode any of the signal peptide sequences of SEQ ID NOs 98-159, or fragments or variants thereof. These sequences may be included at the beginning of the polypeptide coding region, in the middle or at the terminus or alternatively into a flanking region. Further, any of the polynucleotide primary constructs of the present invention may also comprise one or more of the sequences defined by SEQ ID NOs 36-97. These may be in the first region or either flanking region.

Additional signal peptide sequences which may be utilized in the present invention include those taught in, for example, databases such as those found at http://www.signalpeptide.de/ or http://proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

In one embodiment, the modified nucleic acid molecules may include a nucleic acid sequence encoding a nuclear localization signal (NLS) and/or a nuclear export signal (NES). In one aspect, a modified nucleic acid molecules may include a nucleic acid sequence encoding a nuclear localization signal (NLS). The modified nucleic acid molecules encoding a NLS would be able to traffic a polypeptide into the nucleus and deliver a survival or death signal to the nuclear microenvironment. In another aspect, the modified nucleic acid molecules may include a nucleic acid sequence encoding a nuclear export signal such as NES1 and/or NES2. As a nonlimiting example, the modified nucleic acid molecules may encode a NES1, NES2 and a NLS signal and an oncology related polypeptide or a scrambled sequence which is not translatable in order to interact with HIF1-alpha to alter the transcritome of the cancer cells.

Target Selection

According to the present invention, the primary constructs comprise at least a first region of linked nucleosides encoding at least one polypeptide of interest. The polypeptides of interest or "targets" or proteins and peptides of the present invention are listed in U.S. Provisional Patent Application No. 61/618,862, filed Apr. 2, 2012, entitled Modified Polynucleotides for the Production of Biologics; U.S. Provisional Patent Application No. 61/681,645, filed Aug. 10, 2012, entitled Modified Polynucleotides for the Production of Biologics; U.S. Provisional Patent Application No. 61/737,130, filed Dec. 14, 2012, entitled Modified Polynucleotides for the Production of Biologics; U.S. Provisional Patent Application No. 61/618,866, filed Apr. 2, 2012, entitled Modified Polynucleotides for the Production of Antibodies; U.S. Provisional Patent Application No. 61/681,647, filed Aug. 10, 2012, entitled Modified Polynucleotides for the Production of Antibodies; U.S. Provisional Patent Application No. 61/737,134, filed Dec. 14, 2012, entitled Modified Polynucleotides for the Production of Antibodies; U.S. Provisional Patent Application No. 61/618,868, filed Apr. 2, 2012, entitled Modified Polynucleotides for the Production of Vaccines; U.S. Provisional Patent Application No. 61/681,648, filed Aug. 10, 2012, entitled Modified Polynucleotides for the Production of Vaccines; U.S. Provisional Patent Application No. 61/737,135, filed Dec. 14, 2012, entitled Modified Polynucleotides for the Production of Vaccines; U.S. Provisional Patent Application No. 61/618,870, filed Apr. 2, 2012, entitled Modified Polynucleotides for the Production of Therapeutic Proteins and Peptides; U.S. Provisional Patent Application No. 61/681,649, filed Aug. 10, 2012, entitled Modified Polynucleotides for the Production of Therapeutic Proteins and Peptides; U.S. Provisional Patent Application No. 61/737,139, filed Dec. 14, 2012, Modified Polynucleotides for the Production of Therapeutic Proteins and Peptides; U.S. Provisional Patent Application No. 61/618,873, filed Apr. 2, 2012, entitled Modified Polynucleotides for the Production of Secreted Proteins; U.S. Provisional Patent Application No. 61/681,650, filed Aug. 10, 2012, entitled Modified Polynucleotides for the Production of Secreted Proteins; U.S. Provisional Patent Application No. 61/737,147, filed Dec. 14, 2012, entitled Modified Polynucleotides for the Production of Secreted Proteins; U.S. Provisional Patent Application No. 61/618,878, filed Apr. 2, 2012, entitled Modified Polynucleotides for the Production of Plasma Membrane Proteins; U.S. Provisional Patent Application No. 61/681,654, filed Aug. 10, 2012, entitled Modified Polynucleotides for the Production of Plasma Membrane Proteins; U.S. Provisional Patent Application No. 61/737,152, filed Dec. 14, 2012, entitled Modified Polynucleotides for the Production of Plasma Membrane Proteins; U.S. Provisional Patent Application No. 61/618,885, filed Apr. 2, 2012, entitled Modified Polynucleotides for the Production of Cytoplasmic and Cytoskeletal Proteins; U.S. Provisional Patent Application No. 61/681,658, filed Aug. 10, 2012, entitled Modified Polynucleotides for the Production of Cytoplasmic and Cytoskeletal Proteins; U.S. Provisional Patent Application No. 61/737,155, filed Dec. 14, 2012, entitled Modified Polynucleotides for the Production of Cytoplasmic and Cytoskeletal Proteins; U.S. Provisional Patent Application No. 61/618,896, filed Apr. 2, 2012, entitled Modified Polynucleotides for the Production of Intracellular Membrane Bound Proteins; U.S. Provisional Patent Application No. 61/668,157, filed Jul. 5, 2012, entitled Modified Polynucleotides for the Production of Intracellular Membrane Bound Proteins; U.S. Provisional Patent Application No. 61/681,661, filed Aug. 10, 2012, entitled Modified Polynucleotides for the Production of Intracellular Membrane Bound Proteins; U.S. Provisional Patent Application No. 61/737,160, filed Dec. 14, 2012, entitled Modified Polynucleotides for the Production of Intracellular Membrane Bound Proteins; U.S. Provisional Patent Application No. 61/618,911, filed Apr. 2, 2012, entitled Modified Polynucleotides for the Production of Nuclear Proteins; U.S. Provisional Patent Application No. 61/681,667, filed Aug. 10, 2012, entitled Modified Polynucleotides for the Production of Nuclear Proteins; U.S. Provisional Patent Application No. 61/737,168, filed Dec. 14, 2012, entitled Modified Polynucleotides for the Production of Nuclear Proteins; U.S. Provisional Patent Application No. 61/618,922, filed Apr. 2, 2012, entitled Modified Polynucleotides for the Production of Proteins; U.S. Provisional Patent Application No. 61/681,675, filed Aug. 10, 2012, entitled Modified Polynucleotides for the Production of Proteins; U.S. Provisional Patent Application No. 61/737,174, filed Dec. 14, 2012, entitled Modified Polynucleotides for the Production of Proteins; U.S. Provisional Patent Application No. 61/618,935, filed Apr. 2, 2012, entitled Modified Polynucleotides for the Production of Proteins Associated with Human Disease; U.S. Provisional Patent Application No. 61/681,687, filed Aug. 10, 2012, entitled Modified Polynucleotides for the Production of Proteins Associated with Human Disease; U.S. Provisional Patent Application No. 61/737,184, filed Dec. 14, 2012, entitled Modified Polynucleotides for the Production of Proteins Associated with Human Disease; U.S. Provisional Patent Application No. 61/618,945, filed Apr. 2, 2012, entitled Modified Polynucleotides for the Production of Proteins Associated with Human Disease; U.S. Provisional Patent Application No. 61/681,696, filed Aug. 10, 2012, entitled Modified Polynucleotides for the Production of Proteins Associated with Human Disease; U.S. Provisional Patent Application No. 61/737,191, filed Dec. 14, 2012, entitled Modified Polynucleotides for the Production of Proteins Associated with Human Disease; U.S. Provisional Patent Application No. 61/618,953, filed Apr. 2, 2012, entitled Modified Polynucleotides for the Production of Proteins Associated with Human Disease; U.S. Provisional Patent Application No. 61/681,704, filed Aug. 10, 2012, entitled Modified Polynucleotides for the Production of Proteins Associated with Human Disease; U.S. Provisional Patent Application No. 61/737,203, filed Dec. 14, 2012, entitled Modified Polynucleotides for the Production of Proteins Associated with Human Disease, U.S. Provisional Patent Application No. 61/753,661, entitled Polynucleotides For The Alteration Of Cellular Phenotypes And Microenvironments; International Application No PCT/US2013/030062, filed Mar. 9, 2013, entitled Modified Polynucleotides for the Production of Biologics and Proteins Associated with Human Disease; International Application No PCT/US2013/030063, filed Mar. 9, 2013, entitled Modified Polynucleotides; International Application No. PCT/US2013/030064, entitled Modified Polynucleotides for the Production of Secreted Proteins; International Application No PCT/US2013/030059, filed Mar. 9, 2013, entitled Modified Polynucleotides for the Production of Membrane Proteins; International Application No. PCT/US2013/030066, filed Mar. 9, 2013, entitled Modified Polynucleotides for the Production of Cytoplasmic and Cytoskeletal Proteins; International Application No. PCT/US2013/030067, filed Mar. 9, 2013, entitled Modified Polynucleotides for the Production of Nuclear Proteins; International Application No. PCT/US2013/030060, filed Mar. 9, 2013, entitled Modified Polynucleotides for the Production of Proteins; International Application No. PCT/US2013/030061, filed Mar. 9, 2013, entitled Modified Polynucleotides for the Production of Proteins Associated with Human Disease; International Application No. PCT/US2013/030068, filed Mar. 9, 2013, entitled Modified Polynucleotides for the Production of Cosmetic Proteins and Peptides; International Application No. PCT/US2013/030070, filed Mar. 9, 2013, entitled Modified Polynucleotides for the Production of Oncology-Related Proteins and Peptides; and International Application No. PCT/US2013/031821, filed Mar. 15, 2013, entitled In Vivo Production of Proteins, the contents of each of which are herein incorporated by reference in their entireties.

Protein Cleavage Signals and Sites

In one embodiment, the polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

The polypeptides of the present invention may include, but is not limited to, a proprotein convertase (or prohormone convertase), thrombin or Factor Xa protein cleavage signal. Proprotein convertases are a family of nine proteinases, comprising seven basic amino acid-specific subtilisin-like serine proteinases related to yeast kexin, known as prohormone convertase 1/3 (PC1/3), PC2, furin, PC4, PC5/6, paired basic amino-acid cleaving enzyme 4 (PACE4) and PC7, and two other subtilases that cleave at non-basic residues, called subtilisin kexin isozyme 1 (SKI-1) and proprotein convertase subtilisin kexin 9 (PCSK9). Non-limiting examples of protein cleavage signal amino acid sequences are listing in Table 10. In Table 10, "X" refers to any amino acid, "n" may be 0, 2, 4 or 6 amino acids and "*" refers to the protein cleavage site. In Table 10, SEQ ID NO: 162 refers to when n=4 and SEQ ID NO:163 refers to when n=6.

TABLE 10

Protein Cleavage Site Sequences

| Protein Cleavage Signal | Amino Acid Cleavage Sequence | SEQ ID NO |
|---|---|---|
| Proprotein convertase | R-X-X-R* | 160 |
| | R-X-K/R-R* | 161 |
| | K/R-Xn-K/R* | 162 or 163 |
| Thrombin | L-V-P-R*-G-S | 164 |
| | L-V-P-R* | 165 |
| | A/F/G/I/L/T/V/M-A/F/G/I/L/T/V/W/A-P-R* | 166 |
| Factor Xa | I-E-G-R* | 167 |
| | I-D-G-R* | 168 |
| | A-E-G-R* | 169 |
| | A/F/G/I/L/T/V/M-D/E-G-R* | 170 |

In one embodiment, the primary constructs, modified nucleic acids and the mmRNA of the present invention may be engineered such that the primary construct, modified nucleic acid or mmRNA contains at least one encoded protein cleavage signal. The encoded protein cleavage signal may be located before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the primary constructs, modified nucleic acids or mmRNA of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal. One of skill in the art may use Table 5 above or other known methods to determine the appropriate encoded protein cleavage signal to include in the primary constructs, modified nucleic acids or mmRNA of the present invention. For example, starting with the signal of Table 10 and considering the codons of Table 5 one can design a signal for the primary construct which can produce a protein signal in the resulting polypeptide.

In one embodiment, the polypeptides of the present invention include at least one protein cleavage signal and/or site.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

In one embodiment, the primary constructs, modified nucleic acids or mmRNA of the present invention includes at least one encoded protein cleavage signal and/or site.

In one embodiment, the primary constructs, modified nucleic acid or mmRNA of the present invention includes at least one encoded protein cleavage signal and/or site with the proviso that the primary construct, modified nucleic acid or mmRNA does not encode GLP-1.

In one embodiment, the primary constructs, modified nucleic acid or mmRNA of the present invention may include more than one coding region. Where multiple coding regions are present in the primary construct, modified nucleic acid or mmRNA of the present invention, the multiple coding regions may be separated by encoded protein cleavage sites. As a non-limiting example, the primary construct, modified nucleic acid or mmRNA may be signed in an ordered pattern. On such pattern follows AXBY form where A and B are coding regions which may be the same or different coding regions and/or may encode the same or different polypeptides, and X and Y are encoded protein cleavage signals which may encode the same or different protein cleavage signals. A second such pattern follows the form AXYBZ where A and B are coding regions which may be the same or different coding regions and/or may encode the same or different polypeptides, and X, Y and Z are encoded protein cleavage signals which may encode the same or different protein cleavage signals. A third pattern follows the form ABXCY where A, B and C are coding regions which may be the same or different coding regions and/or may encode the same or different polypeptides, and X and Y are encoded protein cleavage signals which may encode the same or different protein cleavage signals.

In on embodiment, the polypeptides, primary constructs, modified nucleic acids and mmRNA can also contain sequences that encode protein cleavage sites so that the polypeptides, primary constructs, modified nucleic acids and mmRNA can be released from a carrier region or a fusion partner by treatment with a specific protease for said protein cleavage site.

Table 11 is a non-exhaustive listing of miR5 and miR binding sites (miR BS) and their sequences which may be used with the present invention.

TABLE 11

Mirs and mir binding sites

| microRNA | mir SEQ ID | MIR BS SEQ ID |
|---|---|---|
| hsa-let-7a-2-3p | 171 | 1192 |
| hsa-let-7a-3p | 172 | 1193 |
| hsa-let-7a-5p | 173 | 1194 |
| hsa-let-7b-3p | 174 | 1195 |
| hsa-let-7b-5p | 175 | 1196 |
| hsa-let-7c | 176 | 1197 |
| hsa-let-7d-3p | 177 | 1198 |
| hsa-let-7d-5p | 178 | 1199 |
| hsa-let-7e-3p | 179 | 1200 |
| hsa-let-7e-5p | 180 | 1201 |
| hsa-let-7f-1-3p | 181 | 1202 |
| hsa-let-7f-2-3p | 182 | 1203 |
| hsa-let-7f-5p | 183 | 1204 |
| hsa-let-7g-3p | 184 | 1205 |
| hsa-let-7g-5p | 185 | 1206 |
| hsa-let-7i-3p | 186 | 1207 |
| hsa-let-7i-5p | 187 | 1208 |
| hsa-miR-1 | 188 | 1209 |
| hsa-miR-100-3p | 189 | 1210 |
| hsa-miR-100-5p | 190 | 1211 |
| hsa-miR-101-3p | 191 | 1212 |
| hsa-miR-101-5p | 192 | 1213 |
| hsa-miR-103a-2-5p | 193 | 1214 |
| hsa-miR-103a-3p | 194 | 1215 |
| hsa-miR-103b | 195 | 1216 |
| hsa-miR-105-3p | 196 | 1217 |
| hsa-miR-105-5p | 197 | 1218 |
| hsa-miR-106a-3p | 198 | 1219 |
| hsa-miR-106a-5p | 199 | 1220 |
| hsa-miR-106b-3p | 200 | 1221 |
| hsa-miR-106b-5p | 201 | 1222 |
| hsa-miR-107 | 202 | 1223 |
| hsa-miR-10a-3p | 203 | 1224 |
| hsa-miR-10a-5p | 204 | 1225 |
| hsa-miR-10b-3p | 205 | 1226 |
| hsa-miR-10b-5p | 206 | 1227 |

TABLE 11-continued

Mirs and mir binding sites

| microRNA | mir SEQ ID | MIR BS SEQ ID |
|---|---|---|
| hsa-miR-1178-3p | 207 | 1228 |
| hsa-miR-1178-5p | 208 | 1229 |
| hsa-miR-1179 | 209 | 1230 |
| hsa-miR-1180 | 210 | 1231 |
| hsa-miR-1181 | 211 | 1232 |
| hsa-miR-1182 | 212 | 1233 |
| hsa-miR-1183 | 213 | 1234 |
| hsa-miR-1184 | 214 | 1235 |
| hsa-miR-1185-1-3p | 215 | 1236 |
| hsa-miR-1185-2-3p | 216 | 1237 |
| hsa-miR-1185-5p | 217 | 1238 |
| hsa-miR-1193 | 218 | 1239 |
| hsa-miR-1197 | 219 | 1240 |
| hsa-miR-1200 | 220 | 1241 |
| hsa-miR-1202 | 221 | 1242 |
| hsa-miR-1203 | 222 | 1243 |
| hsa-miR-1204 | 223 | 1244 |
| hsa-miR-1205 | 224 | 1245 |
| hsa-miR-1206 | 225 | 1246 |
| hsa-miR-1207-3p | 226 | 1247 |
| hsa-miR-1207-5p | 227 | 1248 |
| hsa-miR-1208 | 228 | 1249 |
| hsa-miR-122-3p | 229 | 1250 |
| hsa-miR-1224-3p | 230 | 1251 |
| hsa-miR-1224-5p | 231 | 1252 |
| hsa-miR-1225-3p | 232 | 1253 |
| hsa-miR-1225-5p | 233 | 1254 |
| hsa-miR-122-5p | 234 | 1255 |
| hsa-miR-1226-3p | 235 | 1256 |
| hsa-miR-1226-5p | 236 | 1257 |
| hsa-miR-1227-3p | 237 | 1258 |
| hsa-miR-1227-5p | 238 | 1259 |
| hsa-miR-1228-3p | 239 | 1260 |
| hsa-miR-1228-5p | 240 | 1261 |
| hsa-miR-1229-3p | 241 | 1262 |
| hsa-miR-1229-5p | 242 | 1263 |
| hsa-miR-1231 | 243 | 1264 |
| hsa-miR-1233-1-5p | 244 | 1265 |
| hsa-miR-1233-3p | 245 | 1266 |
| hsa-miR-1234-3p | 246 | 1267 |
| hsa-miR-1234-5p | 247 | 1268 |
| hsa-miR-1236-3p | 248 | 1269 |
| hsa-miR-1236-5p | 249 | 1270 |
| hsa-miR-1237-3p | 250 | 1271 |
| hsa-miR-1237-5p | 251 | 1272 |
| hsa-miR-1238-3p | 252 | 1273 |
| hsa-miR-1238-5p | 253 | 1274 |
| hsa-miR-1243 | 254 | 1275 |
| hsa-miR-124-3p | 255 | 1276 |
| hsa-miR-1244 | 256 | 1277 |
| hsa-miR-1245a | 257 | 1278 |
| hsa-miR-1245b-3p | 258 | 1279 |
| hsa-miR-1245b-5p | 259 | 1280 |
| hsa-miR-124-5p | 260 | 1281 |
| hsa-miR-1246 | 261 | 1282 |
| hsa-miR-1247-3p | 262 | 1283 |
| hsa-miR-1247-5p | 263 | 1284 |
| hsa-miR-1248 | 264 | 1285 |
| hsa-miR-1249 | 265 | 1286 |
| hsa-miR-1250 | 266 | 1287 |
| hsa-miR-1251 | 267 | 1288 |
| hsa-miR-1252 | 268 | 1289 |
| hsa-miR-1253 | 269 | 1290 |
| hsa-miR-1254 | 270 | 1291 |
| hsa-miR-1255a | 271 | 1292 |
| hsa-miR-1255b-2-3p | 272 | 1293 |
| hsa-miR-1255b-5p | 273 | 1294 |
| hsa-miR-1256 | 274 | 1295 |
| hsa-miR-1257 | 275 | 1296 |
| hsa-miR-1258 | 276 | 1297 |
| hsa-miR-125a-3p | 277 | 1298 |
| hsa-miR-125a-5p | 278 | 1299 |
| hsa-miR-125b-1-3p | 279 | 1300 |
| hsa-miR-125b-2-3p | 280 | 1301 |
| hsa-miR-125b-5p | 281 | 1302 |

TABLE 11-continued

Mirs and mir binding sites

| microRNA | mir SEQ ID | MIR BS SEQ ID |
|---|---|---|
| hsa-miR-1260a | 282 | 1303 |
| hsa-miR-1260b | 283 | 1304 |
| hsa-miR-1261 | 284 | 1305 |
| hsa-miR-1262 | 285 | 1306 |
| hsa-miR-1263 | 286 | 1307 |
| hsa-miR-126-3p | 287 | 1308 |
| hsa-miR-1264 | 288 | 1309 |
| hsa-miR-1265 | 289 | 1310 |
| hsa-miR-126-5p | 290 | 1311 |
| hsa-miR-1266 | 291 | 1312 |
| hsa-miR-1267 | 292 | 1313 |
| hsa-miR-1268a | 293 | 1314 |
| hsa-miR-1268b | 294 | 1315 |
| hsa-miR-1269a | 295 | 1316 |
| hsa-miR-1269b | 296 | 1317 |
| hsa-miR-1270 | 297 | 1318 |
| hsa-miR-1271-3p | 298 | 1319 |
| hsa-miR-1271-5p | 299 | 1320 |
| hsa-miR-1272 | 300 | 1321 |
| hsa-miR-1273a | 301 | 1322 |
| hsa-miR-1273c | 302 | 1323 |
| hsa-miR-1273d | 303 | 1324 |
| hsa-miR-1273e | 304 | 1325 |
| hsa-miR-1273f | 305 | 1326 |
| hsa-miR-1273g-3p | 306 | 1327 |
| hsa-miR-1273g-5p | 307 | 1328 |
| hsa-miR-127-3p | 308 | 1329 |
| hsa-miR-1275 | 309 | 1330 |
| hsa-miR-127-5p | 310 | 1331 |
| hsa-miR-1276 | 311 | 1332 |
| hsa-miR-1277-3p | 312 | 1333 |
| hsa-miR-1277-5p | 313 | 1334 |
| hsa-miR-1278 | 314 | 1335 |
| hsa-miR-1279 | 315 | 1336 |
| hsa-miR-128 | 316 | 1337 |
| hsa-miR-1281 | 317 | 1338 |
| hsa-miR-1282 | 318 | 1339 |
| hsa-miR-1283 | 319 | 1340 |
| hsa-miR-1284 | 320 | 1341 |
| hsa-miR-1285-3p | 321 | 1342 |
| hsa-miR-1285-5p | 322 | 1343 |
| hsa-miR-1286 | 323 | 1344 |
| hsa-miR-1287 | 324 | 1345 |
| hsa-miR-1288 | 325 | 1346 |
| hsa-miR-1289 | 326 | 1347 |
| hsa-miR-1290 | 327 | 1348 |
| hsa-miR-1291 | 328 | 1349 |
| hsa-miR-129-1-3p | 329 | 1350 |
| hsa-miR-1292-3p | 330 | 1351 |
| hsa-miR-129-2-3p | 331 | 1352 |
| hsa-miR-1292-5p | 332 | 1353 |
| hsa-miR-1293 | 333 | 1354 |
| hsa-miR-1294 | 334 | 1355 |
| hsa-miR-1295a | 335 | 1356 |
| hsa-miR-1295b-3p | 336 | 1357 |
| hsa-miR-1295b-5p | 337 | 1358 |
| hsa-miR-129-5p | 338 | 1359 |
| hsa-miR-1296 | 339 | 1360 |
| hsa-miR-1297 | 340 | 1361 |
| hsa-miR-1298 | 341 | 1362 |
| hsa-miR-1299 | 342 | 1363 |
| hsa-miR-1301 | 343 | 1364 |
| hsa-miR-1302 | 344 | 1365 |
| hsa-miR-1303 | 345 | 1366 |
| hsa-miR-1304-3p | 346 | 1367 |
| hsa-miR-1304-5p | 347 | 1368 |
| hsa-miR-1305 | 348 | 1369 |
| hsa-miR-1306-3p | 349 | 1370 |
| hsa-miR-1306-5p | 350 | 1371 |
| hsa-miR-1307-3p | 351 | 1372 |
| hsa-miR-1307-5p | 352 | 1373 |
| hsa-miR-130a-3p | 353 | 1374 |
| hsa-miR-130a-5p | 354 | 1375 |
| hsa-miR-130b-3p | 355 | 1376 |
| hsa-miR-130b-5p | 356 | 1377 |
| hsa-miR-1321 | 357 | 1378 |
| hsa-miR-1322 | 358 | 1379 |
| hsa-miR-1323 | 359 | 1380 |
| hsa-miR-132-3p | 360 | 1381 |
| hsa-miR-1324 | 361 | 1382 |
| hsa-miR-132-5p | 362 | 1383 |
| hsa-miR-133a | 363 | 1384 |
| hsa-miR-133b | 364 | 1385 |
| hsa-miR-134 | 365 | 1386 |
| hsa-miR-1343 | 366 | 1387 |
| hsa-miR-135a-3p | 367 | 1388 |
| hsa-miR-135a-5p | 368 | 1389 |
| hsa-miR-135b-3p | 369 | 1390 |
| hsa-miR-135b-5p | 370 | 1391 |
| hsa-miR-136-3p | 371 | 1392 |
| hsa-miR-136-5p | 372 | 1393 |
| hsa-miR-137 | 373 | 1394 |
| hsa-miR-138-1-3p | 374 | 1395 |
| hsa-miR-138-2-3p | 375 | 1396 |
| hsa-miR-138-5p | 376 | 1397 |
| hsa-miR-139-3p | 377 | 1398 |
| hsa-miR-139-5p | 378 | 1399 |
| hsa-miR-140-3p | 379 | 1400 |
| hsa-miR-140-5p | 380 | 1401 |
| hsa-miR-141-3p | 381 | 1402 |
| hsa-miR-141-5p | 382 | 1403 |
| hsa-miR-142-3p | 383 | 1404 |
| hsa-miR-142-5p | 384 | 1405 |
| hsa-miR-143-3p | 385 | 1406 |
| hsa-miR-143-5p | 386 | 1407 |
| hsa-miR-144-3p | 387 | 1408 |
| hsa-miR-144-5p | 388 | 1409 |
| hsa-miR-145-3p | 389 | 1410 |
| hsa-miR-145-5p | 390 | 1411 |
| hsa-miR-1468 | 391 | 1412 |
| hsa-miR-1469 | 392 | 1413 |
| hsa-miR-146a-3p | 393 | 1414 |
| hsa-miR-146a-5p | 394 | 1415 |
| hsa-miR-146b-3p | 395 | 1416 |
| hsa-miR-146b-5p | 396 | 1417 |
| hsa-miR-1470 | 397 | 1418 |
| hsa-miR-1471 | 398 | 1419 |
| hsa-miR-147a | 399 | 1420 |
| hsa-miR-147b | 400 | 1421 |
| hsa-miR-148a-3p | 401 | 1422 |
| hsa-miR-148a-5p | 402 | 1423 |
| hsa-miR-148b-3p | 403 | 1424 |
| hsa-miR-148b-5p | 404 | 1425 |
| hsa-miR-149-3p | 405 | 1426 |
| hsa-miR-149-5p | 406 | 1427 |
| hsa-miR-150-3p | 407 | 1428 |
| hsa-miR-150-5p | 408 | 1429 |
| hsa-miR-151a-3p | 409 | 1430 |
| hsa-miR-151a-5p | 410 | 1431 |
| hsa-miR-151b | 411 | 1432 |
| hsa-miR-152 | 412 | 1433 |
| hsa-miR-153 | 413 | 1434 |
| hsa-miR-1537 | 414 | 1435 |
| hsa-miR-1538 | 415 | 1436 |
| hsa-miR-1539 | 416 | 1437 |
| hsa-miR-154-3p | 417 | 1438 |
| hsa-miR-154-5p | 418 | 1439 |
| hsa-miR-155-3p | 419 | 1440 |
| hsa-miR-155-5p | 420 | 1441 |
| hsa-miR-1587 | 421 | 1442 |
| hsa-miR-15a-3p | 422 | 1443 |
| hsa-miR-15a-5p | 423 | 1444 |
| hsa-miR-15b-3p | 424 | 1445 |
| hsa-miR-15b-5p | 425 | 1446 |
| hsa-miR-16-1-3p | 426 | 1447 |
| hsa-miR-16-2-3p | 427 | 1448 |
| hsa-miR-16-5p | 428 | 1449 |
| hsa-miR-17-3p | 429 | 1450 |
| hsa-miR-17-5p | 430 | 1451 |
| hsa-miR-181a-2-3p | 431 | 1452 |

TABLE 11-continued

Mirs and mir binding sites

| microRNA | mir SEQ ID | MIR BS SEQ ID |
|---|---|---|
| hsa-miR-181a-3p | 432 | 1453 |
| hsa-miR-181a-5p | 433 | 1454 |
| hsa-miR-181b-3p | 434 | 1455 |
| hsa-miR-181b-5p | 435 | 1456 |
| hsa-miR-181c-3p | 436 | 1457 |
| hsa-miR-181c-5p | 437 | 1458 |
| hsa-miR-181d | 438 | 1459 |
| hsa-miR-182-3p | 439 | 1460 |
| hsa-miR-1825 | 440 | 1461 |
| hsa-miR-182-5p | 441 | 1462 |
| hsa-miR-1827 | 442 | 1463 |
| hsa-miR-183-3p | 443 | 1464 |
| hsa-miR-183-5p | 444 | 1465 |
| hsa-miR-184 | 445 | 1466 |
| hsa-miR-185-3p | 446 | 1467 |
| hsa-miR-185-5p | 447 | 1468 |
| hsa-miR-186-3p | 448 | 1469 |
| hsa-miR-186-5p | 449 | 1470 |
| hsa-miR-187-3p | 450 | 1471 |
| hsa-miR-187-5p | 451 | 1472 |
| hsa-miR-188-3p | 452 | 1473 |
| hsa-miR-188-5p | 453 | 1474 |
| hsa-miR-18a-3p | 454 | 1475 |
| hsa-miR-18a-5p | 455 | 1476 |
| hsa-miR-18b-3p | 456 | 1477 |
| hsa-miR-18b-5p | 457 | 1478 |
| hsa-miR-1908 | 458 | 1479 |
| hsa-miR-1909-3p | 459 | 1480 |
| hsa-miR-1909-5p | 460 | 1481 |
| hsa-miR-190a | 461 | 1482 |
| hsa-miR-190b | 462 | 1483 |
| hsa-miR-1910 | 463 | 1484 |
| hsa-miR-1911-3p | 464 | 1485 |
| hsa-miR-1911-5p | 465 | 1486 |
| hsa-miR-1912 | 466 | 1487 |
| hsa-miR-1913 | 467 | 1488 |
| hsa-miR-191-3p | 468 | 1489 |
| hsa-miR-1914-3p | 469 | 1490 |
| hsa-miR-1914-5p | 470 | 1491 |
| hsa-miR-1915-3p | 471 | 1492 |
| hsa-miR-1915-5p | 472 | 1493 |
| hsa-miR-191-5p | 473 | 1494 |
| hsa-miR-192-3p | 474 | 1495 |
| hsa-miR-192-5p | 475 | 1496 |
| hsa-miR-193a-3p | 476 | 1497 |
| hsa-miR-193a-5p | 477 | 1498 |
| hsa-miR-193b-3p | 478 | 1499 |
| hsa-miR-193b-5p | 479 | 1500 |
| hsa-miR-194-3p | 480 | 1501 |
| hsa-miR-194-5p | 481 | 1502 |
| hsa-miR-195-3p | 482 | 1503 |
| hsa-miR-195-5p | 483 | 1504 |
| hsa-miR-196a-3p | 484 | 1505 |
| hsa-miR-196a-5p | 485 | 1506 |
| hsa-miR-196b-3p | 486 | 1507 |
| hsa-miR-196b-5p | 487 | 1508 |
| hsa-miR-1972 | 488 | 1509 |
| hsa-miR-1973 | 489 | 1510 |
| hsa-miR-197-3p | 490 | 1511 |
| hsa-miR-197-5p | 491 | 1512 |
| hsa-miR-1976 | 492 | 1513 |
| hsa-miR-198 | 493 | 1514 |
| hsa-miR-199a-3p | 494 | 1515 |
| hsa-miR-199a-5p | 495 | 1516 |
| hsa-miR-199b-3p | 496 | 1517 |
| hsa-miR-199b-5p | 497 | 1518 |
| hsa-miR-19a-3p | 498 | 1519 |
| hsa-miR-19a-5p | 499 | 1520 |
| hsa-miR-19b-1-5p | 500 | 1521 |
| hsa-miR-19b-2-5p | 501 | 1522 |
| hsa-miR-19b-3p | 502 | 1523 |
| hsa-miR-200a-3p | 503 | 1524 |
| hsa-miR-200a-5p | 504 | 1525 |
| hsa-miR-200b-3p | 505 | 1526 |
| hsa-miR-200b-5p | 506 | 1527 |
| hsa-miR-200c-3p | 507 | 1528 |
| hsa-miR-200c-5p | 508 | 1529 |
| hsa-miR-202-3p | 509 | 1530 |
| hsa-miR-202-5p | 510 | 1531 |
| hsa-miR-203a | 511 | 1532 |
| hsa-miR-203b-3p | 512 | 1533 |
| hsa-miR-203b-5p | 513 | 1534 |
| hsa-miR-204-3p | 514 | 1535 |
| hsa-miR-204-5p | 515 | 1536 |
| hsa-miR-2052 | 516 | 1537 |
| hsa-miR-2053 | 517 | 1538 |
| hsa-miR-205-3p | 518 | 1539 |
| hsa-miR-2054 | 519 | 1540 |
| hsa-miR-205-5p | 520 | 1541 |
| hsa-miR-206 | 521 | 1542 |
| hsa-miR-208a | 522 | 1543 |
| hsa-miR-208b | 523 | 1544 |
| hsa-miR-20a-3p | 524 | 1545 |
| hsa-miR-20a-5p | 525 | 1546 |
| hsa-miR-20b-3p | 526 | 1547 |
| hsa-miR-20b-5p | 527 | 1548 |
| hsa-miR-210 | 528 | 1549 |
| hsa-miR-2110 | 529 | 1550 |
| hsa-miR-2113 | 530 | 1551 |
| hsa-miR-211-3p | 531 | 1552 |
| hsa-miR-2114-3p | 532 | 1553 |
| hsa-miR-2114-5p | 533 | 1554 |
| hsa-miR-2115-3p | 534 | 1555 |
| hsa-miR-2115-5p | 535 | 1556 |
| hsa-miR-211-5p | 536 | 1557 |
| hsa-miR-2116-3p | 537 | 1558 |
| hsa-miR-2116-5p | 538 | 1559 |
| hsa-miR-2117 | 539 | 1560 |
| hsa-miR-212-3p | 540 | 1561 |
| hsa-miR-212-5p | 541 | 1562 |
| hsa-miR-21-3p | 542 | 1563 |
| hsa-miR-214-3p | 543 | 1564 |
| hsa-miR-214-5p | 544 | 1565 |
| hsa-miR-215 | 545 | 1566 |
| hsa-miR-21-5p | 546 | 1567 |
| hsa-miR-216a-3p | 547 | 1568 |
| hsa-miR-216a-5p | 548 | 1569 |
| hsa-miR-216b | 549 | 1570 |
| hsa-miR-217 | 550 | 1571 |
| hsa-miR-218-1-3p | 551 | 1572 |
| hsa-miR-218-2-3p | 552 | 1573 |
| hsa-miR-218-5p | 553 | 1574 |
| hsa-miR-219-1-3p | 554 | 1575 |
| hsa-miR-219-2-3p | 555 | 1576 |
| hsa-miR-219-5p | 556 | 1577 |
| hsa-miR-221-3p | 557 | 1578 |
| hsa-miR-221-5p | 558 | 1579 |
| hsa-miR-222-3p | 559 | 1580 |
| hsa-miR-222-5p | 560 | 1581 |
| hsa-miR-223-3p | 561 | 1582 |
| hsa-miR-223-5p | 562 | 1583 |
| hsa-miR-22-3p | 563 | 1584 |
| hsa-miR-224-3p | 564 | 1585 |
| hsa-miR-224-5p | 565 | 1586 |
| hsa-miR-22-5p | 566 | 1587 |
| hsa-miR-2276 | 567 | 1588 |
| hsa-miR-2277-3p | 568 | 1589 |
| hsa-miR-2277-5p | 569 | 1590 |
| hsa-miR-2278 | 570 | 1591 |
| hsa-miR-2355-3p | 571 | 1592 |
| hsa-miR-2355-5p | 572 | 1593 |
| hsa-miR-2392 | 573 | 1594 |
| hsa-miR-23a-3p | 574 | 1595 |
| hsa-miR-23a-5p | 575 | 1596 |
| hsa-miR-23b-3p | 576 | 1597 |
| hsa-miR-23b-5p | 577 | 1598 |
| hsa-miR-23c | 578 | 1599 |
| hsa-miR-24-1-5p | 579 | 1600 |
| hsa-miR-24-2-5p | 580 | 1601 |
| hsa-miR-24-3p | 581 | 1602 |

TABLE 11-continued

Mirs and mir binding sites

| microRNA | mir SEQ ID | MIR BS SEQ ID |
|---|---|---|
| hsa-miR-2467-3p | 582 | 1603 |
| hsa-miR-2467-5p | 583 | 1604 |
| hsa-miR-25-3p | 584 | 1605 |
| hsa-miR-25-5p | 585 | 1606 |
| hsa-miR-2681-3p | 586 | 1607 |
| hsa-miR-2681-5p | 587 | 1608 |
| hsa-miR-2682-3p | 588 | 1609 |
| hsa-miR-2682-5p | 589 | 1610 |
| hsa-miR-26a-1-3p | 590 | 1611 |
| hsa-miR-26a-2-3p | 591 | 1612 |
| hsa-miR-26a-5p | 592 | 1613 |
| hsa-miR-26b-3p | 593 | 1614 |
| hsa-miR-26b-5p | 594 | 1615 |
| hsa-miR-27a-3p | 595 | 1616 |
| hsa-miR-27a-5p | 596 | 1617 |
| hsa-miR-27b-3p | 597 | 1618 |
| hsa-miR-27b-5p | 598 | 1619 |
| hsa-miR-28-3p | 599 | 1620 |
| hsa-miR-28-5p | 600 | 1621 |
| hsa-miR-2861 | 601 | 1622 |
| hsa-miR-2909 | 602 | 1623 |
| hsa-miR-296-3p | 603 | 1624 |
| hsa-miR-2964a-3p | 604 | 1625 |
| hsa-miR-2964a-5p | 605 | 1626 |
| hsa-miR-296-5p | 606 | 1627 |
| hsa-miR-297 | 607 | 1628 |
| hsa-miR-298 | 608 | 1629 |
| hsa-miR-299-3p | 609 | 1630 |
| hsa-miR-299-5p | 610 | 1631 |
| hsa-miR-29a-3p | 611 | 1632 |
| hsa-miR-29a-5p | 612 | 1633 |
| hsa-miR-29b-1-5p | 613 | 1634 |
| hsa-miR-29b-2-5p | 614 | 1635 |
| hsa-miR-29b-3p | 615 | 1636 |
| hsa-miR-29c-3p | 616 | 1637 |
| hsa-miR-29c-5p | 617 | 1638 |
| hsa-miR-300 | 618 | 1639 |
| hsa-miR-301a-3p | 619 | 1640 |
| hsa-miR-301a-5p | 620 | 1641 |
| hsa-miR-301b | 621 | 1642 |
| hsa-miR-302a-3p | 622 | 1643 |
| hsa-miR-302a-5p | 623 | 1644 |
| hsa-miR-302b-3p | 624 | 1645 |
| hsa-miR-302b-5p | 625 | 1646 |
| hsa-miR-302c-3p | 626 | 1647 |
| hsa-miR-302c-5p | 627 | 1648 |
| hsa-miR-302d-3p | 628 | 1649 |
| hsa-miR-302d-5p | 629 | 1650 |
| hsa-miR-302e | 630 | 1651 |
| hsa-miR-302f | 631 | 1652 |
| hsa-miR-3064-3p | 632 | 1653 |
| hsa-miR-3064-5p | 633 | 1654 |
| hsa-miR-3065-3p | 634 | 1655 |
| hsa-miR-3065-5p | 635 | 1656 |
| hsa-miR-3074-3p | 636 | 1657 |
| hsa-miR-3074-5p | 637 | 1658 |
| hsa-miR-30a-3p | 638 | 1659 |
| hsa-miR-30a-5p | 639 | 1660 |
| hsa-miR-30b-3p | 640 | 1661 |
| hsa-miR-30b-5p | 641 | 1662 |
| hsa-miR-30c-1-3p | 642 | 1663 |
| hsa-miR-30c-2-3p | 643 | 1664 |
| hsa-miR-30c-5p | 644 | 1665 |
| hsa-miR-30d-3p | 645 | 1666 |
| hsa-miR-30d-5p | 646 | 1667 |
| hsa-miR-30e-3p | 647 | 1668 |
| hsa-miR-30e-5p | 648 | 1669 |
| hsa-miR-3115 | 649 | 1670 |
| hsa-miR-3116 | 650 | 1671 |
| hsa-miR-3117-3p | 651 | 1672 |
| hsa-miR-3117-5p | 652 | 1673 |
| hsa-miR-3118 | 653 | 1674 |
| hsa-miR-3119 | 654 | 1675 |
| hsa-miR-3120-3p | 655 | 1676 |
| hsa-miR-3120-5p | 656 | 1677 |
| hsa-miR-3121-3p | 657 | 1678 |
| hsa-miR-3121-5p | 658 | 1679 |
| hsa-miR-3122 | 659 | 1680 |
| hsa-miR-3123 | 660 | 1681 |
| hsa-miR-3124-3p | 661 | 1682 |
| hsa-miR-3124-5p | 662 | 1683 |
| hsa-miR-3125 | 663 | 1684 |
| hsa-miR-3126-3p | 664 | 1685 |
| hsa-miR-3126-5p | 665 | 1686 |
| hsa-miR-3127-3p | 666 | 1687 |
| hsa-miR-3127-5p | 667 | 1688 |
| hsa-miR-3128 | 668 | 1689 |
| hsa-miR-3129-3p | 669 | 1690 |
| hsa-miR-3129-5p | 670 | 1691 |
| hsa-miR-3130-3p | 671 | 1692 |
| hsa-miR-3130-5p | 672 | 1693 |
| hsa-miR-3131 | 673 | 1694 |
| hsa-miR-3132 | 674 | 1695 |
| hsa-miR-3133 | 675 | 1696 |
| hsa-miR-3134 | 676 | 1697 |
| hsa-miR-3135a | 677 | 1698 |
| hsa-miR-3135b | 678 | 1699 |
| hsa-miR-3136-3p | 679 | 1700 |
| hsa-miR-3136-5p | 680 | 1701 |
| hsa-miR-3137 | 681 | 1702 |
| hsa-miR-3138 | 682 | 1703 |
| hsa-miR-3139 | 683 | 1704 |
| hsa-miR-31-3p | 684 | 1705 |
| hsa-miR-3140-3p | 685 | 1706 |
| hsa-miR-3140-5p | 686 | 1707 |
| hsa-miR-3141 | 687 | 1708 |
| hsa-miR-3142 | 688 | 1709 |
| hsa-miR-3143 | 689 | 1710 |
| hsa-miR-3144-3p | 690 | 1711 |
| hsa-miR-3144-5p | 691 | 1712 |
| hsa-miR-3145-3p | 692 | 1713 |
| hsa-miR-3145-5p | 693 | 1714 |
| hsa-miR-3146 | 694 | 1715 |
| hsa-miR-3147 | 695 | 1716 |
| hsa-miR-3148 | 696 | 1717 |
| hsa-miR-3149 | 697 | 1718 |
| hsa-miR-3150a-3p | 698 | 1719 |
| hsa-miR-3150a-5p | 699 | 1720 |
| hsa-miR-3150b-3p | 700 | 1721 |
| hsa-miR-3150b-5p | 701 | 1722 |
| hsa-miR-3151 | 702 | 1723 |
| hsa-miR-3152-3p | 703 | 1724 |
| hsa-miR-3152-5p | 704 | 1725 |
| hsa-miR-3153 | 705 | 1726 |
| hsa-miR-3154 | 706 | 1727 |
| hsa-miR-3155a | 707 | 1728 |
| hsa-miR-3155b | 708 | 1729 |
| hsa-miR-3156-3p | 709 | 1730 |
| hsa-miR-3156-5p | 710 | 1731 |
| hsa-miR-3157-3p | 711 | 1732 |
| hsa-miR-3157-5p | 712 | 1733 |
| hsa-miR-3158-3p | 713 | 1734 |
| hsa-miR-3158-5p | 714 | 1735 |
| hsa-miR-3159 | 715 | 1736 |
| hsa-miR-31-5p | 716 | 1737 |
| hsa-miR-3160-3p | 717 | 1738 |
| hsa-miR-3160-5p | 718 | 1739 |
| hsa-miR-3161 | 719 | 1740 |
| hsa-miR-3162-3p | 720 | 1741 |
| hsa-miR-3162-5p | 721 | 1742 |
| hsa-miR-3163 | 722 | 1743 |
| hsa-miR-3164 | 723 | 1744 |
| hsa-miR-3165 | 724 | 1745 |
| hsa-miR-3166 | 725 | 1746 |
| hsa-miR-3167 | 726 | 1747 |
| hsa-miR-3168 | 727 | 1748 |
| hsa-miR-3169 | 728 | 1749 |
| hsa-miR-3170 | 729 | 1750 |
| hsa-miR-3171 | 730 | 1751 |
| hsa-miR-3173-3p | 731 | 1752 |

TABLE 11-continued

Mirs and mir binding sites

| microRNA | mir SEQ ID | MIR BS SEQ ID |
|---|---|---|
| hsa-miR-3173-5p | 732 | 1753 |
| hsa-miR-3174 | 733 | 1754 |
| hsa-miR-3175 | 734 | 1755 |
| hsa-miR-3176 | 735 | 1756 |
| hsa-miR-3177-3p | 736 | 1757 |
| hsa-miR-3177-5p | 737 | 1758 |
| hsa-miR-3178 | 738 | 1759 |
| hsa-miR-3179 | 739 | 1760 |
| hsa-miR-3180 | 740 | 1761 |
| hsa-miR-3180-3p | 741 | 1762 |
| hsa-miR-3180-5p | 742 | 1763 |
| hsa-miR-3181 | 743 | 1764 |
| hsa-miR-3182 | 744 | 1765 |
| hsa-miR-3183 | 745 | 1766 |
| hsa-miR-3184-3p | 746 | 1767 |
| hsa-miR-3184-5p | 747 | 1768 |
| hsa-miR-3185 | 748 | 1769 |
| hsa-miR-3186-3p | 749 | 1770 |
| hsa-miR-3186-5p | 750 | 1771 |
| hsa-miR-3187-3p | 751 | 1772 |
| hsa-miR-3187-5p | 752 | 1773 |
| hsa-miR-3188 | 753 | 1774 |
| hsa-miR-3189-3p | 754 | 1775 |
| hsa-miR-3189-5p | 755 | 1776 |
| hsa-miR-3190-3p | 756 | 1777 |
| hsa-miR-3190-5p | 757 | 1778 |
| hsa-miR-3191-3p | 758 | 1779 |
| hsa-miR-3191-5p | 759 | 1780 |
| hsa-miR-3192 | 760 | 1781 |
| hsa-miR-3193 | 761 | 1782 |
| hsa-miR-3194-3p | 762 | 1783 |
| hsa-miR-3194-5p | 763 | 1784 |
| hsa-miR-3195 | 764 | 1785 |
| hsa-miR-3196 | 765 | 1786 |
| hsa-miR-3197 | 766 | 1787 |
| hsa-miR-3198 | 767 | 1788 |
| hsa-miR-3199 | 768 | 1789 |
| hsa-miR-3200-3p | 769 | 1790 |
| hsa-miR-3200-5p | 770 | 1791 |
| hsa-miR-3201 | 771 | 1792 |
| hsa-miR-3202 | 772 | 1793 |
| hsa-miR-320a | 773 | 1794 |
| hsa-miR-320b | 774 | 1795 |
| hsa-miR-320c | 775 | 1796 |
| hsa-miR-320d | 776 | 1797 |
| hsa-miR-320e | 777 | 1798 |
| hsa-miR-323a-3p | 778 | 1799 |
| hsa-miR-323a-5p | 779 | 1800 |
| hsa-miR-323b-3p | 780 | 1801 |
| hsa-miR-323b-5p | 781 | 1802 |
| hsa-miR-32-3p | 782 | 1803 |
| hsa-miR-324-3p | 783 | 1804 |
| hsa-miR-324-5p | 784 | 1805 |
| hsa-miR-325 | 785 | 1806 |
| hsa-miR-32-5p | 786 | 1807 |
| hsa-miR-326 | 787 | 1808 |
| hsa-miR-328 | 788 | 1809 |
| hsa-miR-329 | 789 | 1810 |
| hsa-miR-330-3p | 790 | 1811 |
| hsa-miR-330-5p | 791 | 1812 |
| hsa-miR-331-3p | 792 | 1813 |
| hsa-miR-331-5p | 793 | 1814 |
| hsa-miR-335-3p | 794 | 1815 |
| hsa-miR-335-5p | 795 | 1816 |
| hsa-miR-337-3p | 796 | 1817 |
| hsa-miR-337-5p | 797 | 1818 |
| hsa-miR-338-3p | 798 | 1819 |
| hsa-miR-338-5p | 799 | 1820 |
| hsa-miR-339-3p | 800 | 1821 |
| hsa-miR-339-5p | 801 | 1822 |
| hsa-miR-33a-3p | 802 | 1823 |
| hsa-miR-33a-5p | 803 | 1824 |
| hsa-miR-33b-3p | 804 | 1825 |
| hsa-miR-33b-5p | 805 | 1826 |
| hsa-miR-340-3p | 806 | 1827 |
| hsa-miR-340-5p | 807 | 1828 |
| hsa-miR-342-3p | 808 | 1829 |
| hsa-miR-342-5p | 809 | 1830 |
| hsa-miR-345-3p | 810 | 1831 |
| hsa-miR-345-5p | 811 | 1832 |
| hsa-miR-346 | 812 | 1833 |
| hsa-miR-34a-3p | 813 | 1834 |
| hsa-miR-34a-5p | 814 | 1835 |
| hsa-miR-34b-3p | 815 | 1836 |
| hsa-miR-34b-5p | 816 | 1837 |
| hsa-miR-34c-3p | 817 | 1838 |
| hsa-miR-34c-5p | 818 | 1839 |
| hsa-miR-3529-3p | 819 | 1840 |
| hsa-miR-3529-5p | 820 | 1841 |
| hsa-miR-3591-3p | 821 | 1842 |
| hsa-miR-3591-5p | 822 | 1843 |
| hsa-miR-3605-3p | 823 | 1844 |
| hsa-miR-3605-5p | 824 | 1845 |
| hsa-miR-3606-3p | 825 | 1846 |
| hsa-miR-3606-5p | 826 | 1847 |
| hsa-miR-3607-3p | 827 | 1848 |
| hsa-miR-3607-5p | 828 | 1849 |
| hsa-miR-3609 | 829 | 1850 |
| hsa-miR-3610 | 830 | 1851 |
| hsa-miR-3611 | 831 | 1852 |
| hsa-miR-3612 | 832 | 1853 |
| hsa-miR-3613-3p | 833 | 1854 |
| hsa-miR-3613-5p | 834 | 1855 |
| hsa-miR-361-3p | 835 | 1856 |
| hsa-miR-3614-3p | 836 | 1857 |
| hsa-miR-3614-5p | 837 | 1858 |
| hsa-miR-3615 | 838 | 1859 |
| hsa-miR-361-5p | 839 | 1860 |
| hsa-miR-3616-3p | 840 | 1861 |
| hsa-miR-3616-5p | 841 | 1862 |
| hsa-miR-3617-3p | 842 | 1863 |
| hsa-miR-3617-5p | 843 | 1864 |
| hsa-miR-3618 | 844 | 1865 |
| hsa-miR-3619-3p | 845 | 1866 |
| hsa-miR-3619-5p | 846 | 1867 |
| hsa-miR-3620-3p | 847 | 1868 |
| hsa-miR-3620-5p | 848 | 1869 |
| hsa-miR-3621 | 849 | 1870 |
| hsa-miR-3622a-3p | 850 | 1871 |
| hsa-miR-3622a-5p | 851 | 1872 |
| hsa-miR-3622b-3p | 852 | 1873 |
| hsa-miR-3622b-5p | 853 | 1874 |
| hsa-miR-362-3p | 854 | 1875 |
| hsa-miR-362-5p | 855 | 1876 |
| hsa-miR-363-3p | 856 | 1877 |
| hsa-miR-363-5p | 857 | 1878 |
| hsa-miR-3646 | 858 | 1879 |
| hsa-miR-3648 | 859 | 1880 |
| hsa-miR-3649 | 860 | 1881 |
| hsa-miR-3650 | 861 | 1882 |
| hsa-miR-3651 | 862 | 1883 |
| hsa-miR-3652 | 863 | 1884 |
| hsa-miR-3653 | 864 | 1885 |
| hsa-miR-3654 | 865 | 1886 |
| hsa-miR-3655 | 866 | 1887 |
| hsa-miR-3656 | 867 | 1888 |
| hsa-miR-3657 | 868 | 1889 |
| hsa-miR-3658 | 869 | 1890 |
| hsa-miR-3659 | 870 | 1891 |
| hsa-miR-365a-3p | 871 | 1892 |
| hsa-miR-365a-5p | 872 | 1893 |
| hsa-miR-365b-3p | 873 | 1894 |
| hsa-miR-365b-5p | 874 | 1895 |
| hsa-miR-3660 | 875 | 1896 |
| hsa-miR-3661 | 876 | 1897 |
| hsa-miR-3662 | 877 | 1898 |
| hsa-miR-3663-3p | 878 | 1899 |
| hsa-miR-3663-5p | 879 | 1900 |
| hsa-miR-3664-3p | 880 | 1901 |
| hsa-miR-3664-5p | 881 | 1902 |

TABLE 11-continued

Mirs and mir binding sites

| microRNA | mir SEQ ID | MIR BS SEQ ID |
|---|---|---|
| hsa-miR-3665 | 882 | 1903 |
| hsa-miR-3666 | 883 | 1904 |
| hsa-miR-3667-3p | 884 | 1905 |
| hsa-miR-3667-5p | 885 | 1906 |
| hsa-miR-3668 | 886 | 1907 |
| hsa-miR-3669 | 887 | 1908 |
| hsa-miR-3670 | 888 | 1909 |
| hsa-miR-3671 | 889 | 1910 |
| hsa-miR-3672 | 890 | 1911 |
| hsa-miR-3673 | 891 | 1912 |
| hsa-miR-367-3p | 892 | 1913 |
| hsa-miR-3674 | 893 | 1914 |
| hsa-miR-3675-3p | 894 | 1915 |
| hsa-miR-3675-5p | 895 | 1916 |
| hsa-miR-367-5p | 896 | 1917 |
| hsa-miR-3676-3p | 897 | 1918 |
| hsa-miR-3676-5p | 898 | 1919 |
| hsa-miR-3677-3p | 899 | 1920 |
| hsa-miR-3677-5p | 900 | 1921 |
| hsa-miR-3678-3p | 901 | 1922 |
| hsa-miR-3678-5p | 902 | 1923 |
| hsa-miR-3679-3p | 903 | 1924 |
| hsa-miR-3679-5p | 904 | 1925 |
| hsa-miR-3680-3p | 905 | 1926 |
| hsa-miR-3680-5p | 906 | 1927 |
| hsa-miR-3681-3p | 907 | 1928 |
| hsa-miR-3681-5p | 908 | 1929 |
| hsa-miR-3682-3p | 909 | 1930 |
| hsa-miR-3682-5p | 910 | 1931 |
| hsa-miR-3683 | 911 | 1932 |
| hsa-miR-3684 | 912 | 1933 |
| hsa-miR-3685 | 913 | 1934 |
| hsa-miR-3686 | 914 | 1935 |
| hsa-miR-3687 | 915 | 1936 |
| hsa-miR-3688-3p | 916 | 1937 |
| hsa-miR-3688-5p | 917 | 1938 |
| hsa-miR-3689a-3p | 918 | 1939 |
| hsa-miR-3689a-5p | 919 | 1940 |
| hsa-miR-3689b-3p | 920 | 1941 |
| hsa-miR-3689b-5p | 921 | 1942 |
| hsa-miR-3689c | 922 | 1943 |
| hsa-miR-3689d | 923 | 1944 |
| hsa-miR-3689e | 924 | 1945 |
| hsa-miR-3689f | 925 | 1946 |
| hsa-miR-3690 | 926 | 1947 |
| hsa-miR-3691-3p | 927 | 1948 |
| hsa-miR-3691-5p | 928 | 1949 |
| hsa-miR-3692-3p | 929 | 1950 |
| hsa-miR-3692-5p | 930 | 1951 |
| hsa-miR-369-3p | 931 | 1952 |
| hsa-miR-369-5p | 932 | 1953 |
| hsa-miR-370 | 933 | 1954 |
| hsa-miR-3713 | 934 | 1955 |
| hsa-miR-3714 | 935 | 1956 |
| hsa-miR-371a-3p | 936 | 1957 |
| hsa-miR-371a-5p | 937 | 1958 |
| hsa-miR-371b-3p | 938 | 1959 |
| hsa-miR-371b-5p | 939 | 1960 |
| hsa-miR-372 | 940 | 1961 |
| hsa-miR-373-3p | 941 | 1962 |
| hsa-miR-373-5p | 942 | 1963 |
| hsa-miR-374a-3p | 943 | 1964 |
| hsa-miR-374a-5p | 944 | 1965 |
| hsa-miR-374b-3p | 945 | 1966 |
| hsa-miR-374b-5p | 946 | 1967 |
| hsa-miR-374c-3p | 947 | 1968 |
| hsa-miR-374c-5p | 948 | 1969 |
| hsa-miR-375 | 949 | 1970 |
| hsa-miR-376a-2-5p | 950 | 1971 |
| hsa-miR-376a-3p | 951 | 1972 |
| hsa-miR-376a-5p | 952 | 1973 |
| hsa-miR-376b-3p | 953 | 1974 |
| hsa-miR-376b-5p | 954 | 1975 |
| hsa-miR-376c-3p | 955 | 1976 |
| hsa-miR-376c-5p | 956 | 1977 |
| hsa-miR-377-3p | 957 | 1978 |
| hsa-miR-377-5p | 958 | 1979 |
| hsa-miR-378a-3p | 959 | 1980 |
| hsa-miR-378a-5p | 960 | 1981 |
| hsa-miR-378b | 961 | 1982 |
| hsa-miR-378c | 962 | 1983 |
| hsa-miR-378d | 963 | 1984 |
| hsa-miR-378e | 964 | 1985 |
| hsa-miR-378f | 965 | 1986 |
| hsa-miR-378g | 966 | 1987 |
| hsa-miR-378h | 967 | 1988 |
| hsa-miR-378i | 968 | 1989 |
| hsa-miR-378j | 969 | 1990 |
| hsa-miR-379-3p | 970 | 1991 |
| hsa-miR-379-5p | 971 | 1992 |
| hsa-miR-380-3p | 972 | 1993 |
| hsa-miR-380-5p | 973 | 1994 |
| hsa-miR-381-3p | 974 | 1995 |
| hsa-miR-381-5p | 975 | 1996 |
| hsa-miR-382-3p | 976 | 1997 |
| hsa-miR-382-5p | 977 | 1998 |
| hsa-miR-383 | 978 | 1999 |
| hsa-miR-384 | 979 | 2000 |
| hsa-miR-3907 | 980 | 2001 |
| hsa-miR-3908 | 981 | 2002 |
| hsa-miR-3909 | 982 | 2003 |
| hsa-miR-3910 | 983 | 2004 |
| hsa-miR-3911 | 984 | 2005 |
| hsa-miR-3912 | 985 | 2006 |
| hsa-miR-3913-3p | 986 | 2007 |
| hsa-miR-3913-5p | 987 | 2008 |
| hsa-miR-3914 | 988 | 2009 |
| hsa-miR-3915 | 989 | 2010 |
| hsa-miR-3916 | 990 | 2011 |
| hsa-miR-3917 | 991 | 2012 |
| hsa-miR-3918 | 992 | 2013 |
| hsa-miR-3919 | 993 | 2014 |
| hsa-miR-3920 | 994 | 2015 |
| hsa-miR-3921 | 995 | 2016 |
| hsa-miR-3922-3p | 996 | 2017 |
| hsa-miR-3922-5p | 997 | 2018 |
| hsa-miR-3923 | 998 | 2019 |
| hsa-miR-3924 | 999 | 2020 |
| hsa-miR-3925-3p | 1000 | 2021 |
| hsa-miR-3925-5p | 1001 | 2022 |
| hsa-miR-3926 | 1002 | 2023 |
| hsa-miR-3927-3p | 1003 | 2024 |
| hsa-miR-3927-5p | 1004 | 2025 |
| hsa-miR-3928 | 1005 | 2026 |
| hsa-miR-3929 | 1006 | 2027 |
| hsa-miR-3934-3p | 1007 | 2028 |
| hsa-miR-3934-5p | 1008 | 2029 |
| hsa-miR-3935 | 1009 | 2030 |
| hsa-miR-3936 | 1010 | 2031 |
| hsa-miR-3937 | 1011 | 2032 |
| hsa-miR-3938 | 1012 | 2033 |
| hsa-miR-3939 | 1013 | 2034 |
| hsa-miR-3940-3p | 1014 | 2035 |
| hsa-miR-3940-5p | 1015 | 2036 |
| hsa-miR-3941 | 1016 | 2037 |
| hsa-miR-3942-3p | 1017 | 2038 |
| hsa-miR-3942-5p | 1018 | 2039 |
| hsa-miR-3943 | 1019 | 2040 |
| hsa-miR-3944-3p | 1020 | 2041 |
| hsa-miR-3944-5p | 1021 | 2042 |
| hsa-miR-3945 | 1022 | 2043 |
| hsa-miR-3960 | 1023 | 2044 |
| hsa-miR-3972 | 1024 | 2045 |
| hsa-miR-3973 | 1025 | 2046 |
| hsa-miR-3974 | 1026 | 2047 |
| hsa-miR-3975 | 1027 | 2048 |
| hsa-miR-3976 | 1028 | 2049 |
| hsa-miR-3977 | 1029 | 2050 |
| hsa-miR-3978 | 1030 | 2051 |
| hsa-miR-409-3p | 1031 | 2052 |

TABLE 11-continued

Mirs and mir binding sites

| microRNA | mir SEQ ID | MIR BS SEQ ID |
|---|---|---|
| hsa-miR-409-5p | 1032 | 2053 |
| hsa-miR-410 | 1033 | 2054 |
| hsa-miR-411-3p | 1034 | 2055 |
| hsa-miR-411-5p | 1035 | 2056 |
| hsa-miR-412 | 1036 | 2057 |
| hsa-miR-421 | 1037 | 2058 |
| hsa-miR-422a | 1038 | 2059 |
| hsa-miR-423-3p | 1039 | 2060 |
| hsa-miR-423-5p | 1040 | 2061 |
| hsa-miR-424-3p | 1041 | 2062 |
| hsa-miR-424-5p | 1042 | 2063 |
| hsa-miR-4251 | 1043 | 2064 |
| hsa-miR-4252 | 1044 | 2065 |
| hsa-miR-4253 | 1045 | 2066 |
| hsa-miR-425-3p | 1046 | 2067 |
| hsa-miR-4254 | 1047 | 2068 |
| hsa-miR-4255 | 1048 | 2069 |
| hsa-miR-425-5p | 1049 | 2070 |
| hsa-miR-4256 | 1050 | 2071 |
| hsa-miR-4257 | 1051 | 2072 |
| hsa-miR-4258 | 1052 | 2073 |
| hsa-miR-4259 | 1053 | 2074 |
| hsa-miR-4260 | 1054 | 2075 |
| hsa-miR-4261 | 1055 | 2076 |
| hsa-miR-4262 | 1056 | 2077 |
| hsa-miR-4263 | 1057 | 2078 |
| hsa-miR-4264 | 1058 | 2079 |
| hsa-miR-4265 | 1059 | 2080 |
| hsa-miR-4266 | 1060 | 2081 |
| hsa-miR-4267 | 1061 | 2082 |
| hsa-miR-4268 | 1062 | 2083 |
| hsa-miR-4269 | 1063 | 2084 |
| hsa-miR-4270 | 1064 | 2085 |
| hsa-miR-4271 | 1065 | 2086 |
| hsa-miR-4272 | 1066 | 2087 |
| hsa-miR-4273 | 1067 | 2088 |
| hsa-miR-4274 | 1068 | 2089 |
| hsa-miR-4275 | 1069 | 2090 |
| hsa-miR-4276 | 1070 | 2091 |
| hsa-miR-4277 | 1071 | 2092 |
| hsa-miR-4278 | 1072 | 2093 |
| hsa-miR-4279 | 1073 | 2094 |
| hsa-miR-4280 | 1074 | 2095 |
| hsa-miR-4281 | 1075 | 2096 |
| hsa-miR-4282 | 1076 | 2097 |
| hsa-miR-4283 | 1077 | 2098 |
| hsa-miR-4284 | 1078 | 2099 |
| hsa-miR-4285 | 1079 | 2100 |
| hsa-miR-4286 | 1080 | 2101 |
| hsa-miR-4287 | 1081 | 2102 |
| hsa-miR-4288 | 1082 | 2103 |
| hsa-miR-4289 | 1083 | 2104 |
| hsa-miR-429 | 1084 | 2105 |
| hsa-miR-4290 | 1085 | 2106 |
| hsa-miR-4291 | 1086 | 2107 |
| hsa-miR-4292 | 1087 | 2108 |
| hsa-miR-4293 | 1088 | 2109 |
| hsa-miR-4294 | 1089 | 2110 |
| hsa-miR-4295 | 1090 | 2111 |
| hsa-miR-4296 | 1091 | 2112 |
| hsa-miR-4297 | 1092 | 2113 |
| hsa-miR-4298 | 1093 | 2114 |
| hsa-miR-4299 | 1094 | 2115 |
| hsa-miR-4300 | 1095 | 2116 |
| hsa-miR-4301 | 1096 | 2117 |
| hsa-miR-4302 | 1097 | 2118 |
| hsa-miR-4303 | 1098 | 2119 |
| hsa-miR-4304 | 1099 | 2120 |
| hsa-miR-4305 | 1100 | 2121 |
| hsa-miR-4306 | 1101 | 2122 |
| hsa-miR-4307 | 1102 | 2123 |
| hsa-miR-4308 | 1103 | 2124 |
| hsa-miR-4309 | 1104 | 2125 |
| hsa-miR-4310 | 1105 | 2126 |
| hsa-miR-4311 | 1106 | 2127 |
| hsa-miR-4312 | 1107 | 2128 |
| hsa-miR-4313 | 1108 | 2129 |
| hsa-miR-431-3p | 1109 | 2130 |
| hsa-miR-4314 | 1110 | 2131 |
| hsa-miR-4315 | 1111 | 2132 |
| hsa-miR-431-5p | 1112 | 2133 |
| hsa-miR-4316 | 1113 | 2134 |
| hsa-miR-4317 | 1114 | 2135 |
| hsa-miR-4318 | 1115 | 2136 |
| hsa-miR-4319 | 1116 | 2137 |
| hsa-miR-4320 | 1117 | 2138 |
| hsa-miR-4321 | 1118 | 2139 |
| hsa-miR-4322 | 1119 | 2140 |
| hsa-miR-4323 | 1120 | 2141 |
| hsa-miR-432-3p | 1121 | 2142 |
| hsa-miR-4324 | 1122 | 2143 |
| hsa-miR-4325 | 1123 | 2144 |
| hsa-miR-432-5p | 1124 | 2145 |
| hsa-miR-4326 | 1125 | 2146 |
| hsa-miR-4327 | 1126 | 2147 |
| hsa-miR-4328 | 1127 | 2148 |
| hsa-miR-4329 | 1128 | 2149 |
| hsa-miR-433 | 1129 | 2150 |
| hsa-miR-4330 | 1130 | 2151 |
| hsa-miR-4417 | 1131 | 2152 |
| hsa-miR-4418 | 1132 | 2153 |
| hsa-miR-4419a | 1133 | 2154 |
| hsa-miR-4419b | 1134 | 2155 |
| hsa-miR-4420 | 1135 | 2156 |
| hsa-miR-4421 | 1136 | 2157 |
| hsa-miR-4422 | 1137 | 2158 |
| hsa-miR-4423-3p | 1138 | 2159 |
| hsa-miR-4423-5p | 1139 | 2160 |
| hsa-miR-4424 | 1140 | 2161 |
| hsa-miR-4425 | 1141 | 2162 |
| hsa-miR-4426 | 1142 | 2163 |
| hsa-miR-4427 | 1143 | 2164 |
| hsa-miR-4428 | 1144 | 2165 |
| hsa-miR-4429 | 1145 | 2166 |
| hsa-miR-4430 | 1146 | 2167 |
| hsa-miR-4431 | 1147 | 2168 |
| hsa-miR-4432 | 1148 | 2169 |
| hsa-miR-4433-3p | 1149 | 2170 |
| hsa-miR-4433-5p | 1150 | 2171 |
| hsa-miR-4434 | 1151 | 2172 |
| hsa-miR-4435 | 1152 | 2173 |
| hsa-miR-4436a | 1153 | 2174 |
| hsa-miR-4436b-3p | 1154 | 2175 |
| hsa-miR-4436b-5p | 1155 | 2176 |
| hsa-miR-4437 | 1156 | 2177 |
| hsa-miR-4438 | 1157 | 2178 |
| hsa-miR-4439 | 1158 | 2179 |
| hsa-miR-4440 | 1159 | 2180 |
| hsa-miR-4441 | 1160 | 2181 |
| hsa-miR-4442 | 1161 | 2182 |
| hsa-miR-4443 | 1162 | 2183 |
| hsa-miR-4444 | 1163 | 2184 |
| hsa-miR-4445-3p | 1164 | 2185 |
| hsa-miR-4445-5p | 1165 | 2186 |
| hsa-miR-4446-3p | 1166 | 2187 |
| hsa-miR-4446-5p | 1167 | 2188 |
| hsa-miR-4447 | 1168 | 2189 |
| hsa-miR-4448 | 1169 | 2190 |
| hsa-miR-4449 | 1170 | 2191 |
| hsa-miR-4450 | 1171 | 2192 |
| hsa-miR-4451 | 1172 | 2193 |
| hsa-miR-4452 | 1173 | 2194 |
| hsa-miR-4453 | 1174 | 2195 |
| hsa-miR-4454 | 1175 | 2196 |
| hsa-miR-4455 | 1176 | 2197 |
| hsa-miR-4456 | 1177 | 2198 |
| hsa-miR-4457 | 1178 | 2199 |
| hsa-miR-4458 | 1179 | 2200 |
| hsa-miR-4459 | 1180 | 2201 |
| hsa-miR-4460 | 1181 | 2202 |

TABLE 11-continued

Mirs and mir binding sites

| microRNA | mir SEQ ID | MIR BS SEQ ID |
|---|---|---|
| hsa-miR-4461 | 1182 | 2203 |
| hsa-miR-4462 | 1183 | 2204 |
| hsa-miR-4463 | 1184 | 2205 |
| hsa-miR-4464 | 1185 | 2206 |
| hsa-miR-4465 | 1186 | 2207 |
| hsa-miR-4466 | 1187 | 2208 |
| hsa-miR-4467 | 1188 | 2209 |
| hsa-miR-4468 | 1189 | 2210 |
| hsa-miR-4469 | 1190 | 2211 |
| hsa-miR-4470 | 1191 | 2212 |
| hsa-miR-4471 | 2213 | 3234 |
| hsa-miR-4472 | 2214 | 3235 |
| hsa-miR-4473 | 2215 | 3236 |
| hsa-miR-4474-3p | 2216 | 3237 |
| hsa-miR-4474-5p | 2217 | 3238 |
| hsa-miR-4475 | 2218 | 3239 |
| hsa-miR-4476 | 2219 | 3240 |
| hsa-miR-4477a | 2220 | 3241 |
| hsa-miR-4477b | 2221 | 3242 |
| hsa-miR-4478 | 2222 | 3243 |
| hsa-miR-4479 | 2223 | 3244 |
| hsa-miR-448 | 2224 | 3245 |
| hsa-miR-4480 | 2225 | 3246 |
| hsa-miR-4481 | 2226 | 3247 |
| hsa-miR-4482-3p | 2227 | 3248 |
| hsa-miR-4482-5p | 2228 | 3249 |
| hsa-miR-4483 | 2229 | 3250 |
| hsa-miR-4484 | 2230 | 3251 |
| hsa-miR-4485 | 2231 | 3252 |
| hsa-miR-4486 | 2232 | 3253 |
| hsa-miR-4487 | 2233 | 3254 |
| hsa-miR-4488 | 2234 | 3255 |
| hsa-miR-4489 | 2235 | 3256 |
| hsa-miR-4490 | 2236 | 3257 |
| hsa-miR-4491 | 2237 | 3258 |
| hsa-miR-4492 | 2238 | 3259 |
| hsa-miR-4493 | 2239 | 3260 |
| hsa-miR-4494 | 2240 | 3261 |
| hsa-miR-4495 | 2241 | 3262 |
| hsa-miR-4496 | 2242 | 3263 |
| hsa-miR-4497 | 2243 | 3264 |
| hsa-miR-4498 | 2244 | 3265 |
| hsa-miR-4499 | 2245 | 3266 |
| hsa-miR-449a | 2246 | 3267 |
| hsa-miR-449b-3p | 2247 | 3268 |
| hsa-miR-449b-5p | 2248 | 3269 |
| hsa-miR-449c-3p | 2249 | 3270 |
| hsa-miR-449c-5p | 2250 | 3271 |
| hsa-miR-4500 | 2251 | 3272 |
| hsa-miR-4501 | 2252 | 3273 |
| hsa-miR-4502 | 2253 | 3274 |
| hsa-miR-4503 | 2254 | 3275 |
| hsa-miR-4504 | 2255 | 3276 |
| hsa-miR-4505 | 2256 | 3277 |
| hsa-miR-4506 | 2257 | 3278 |
| hsa-miR-4507 | 2258 | 3279 |
| hsa-miR-4508 | 2259 | 3280 |
| hsa-miR-4509 | 2260 | 3281 |
| hsa-miR-450a-3p | 2261 | 3282 |
| hsa-miR-450a-5p | 2262 | 3283 |
| hsa-miR-450b-3p | 2263 | 3284 |
| hsa-miR-450b-5p | 2264 | 3285 |
| hsa-miR-4510 | 2265 | 3286 |
| hsa-miR-4511 | 2266 | 3287 |
| hsa-miR-4512 | 2267 | 3288 |
| hsa-miR-4513 | 2268 | 3289 |
| hsa-miR-4514 | 2269 | 3290 |
| hsa-miR-4515 | 2270 | 3291 |
| hsa-miR-4516 | 2271 | 3292 |
| hsa-miR-4517 | 2272 | 3293 |
| hsa-miR-4518 | 2273 | 3294 |
| hsa-miR-4519 | 2274 | 3295 |
| hsa-miR-451a | 2275 | 3296 |
| hsa-miR-451b | 2276 | 3297 |
| hsa-miR-4520a-3p | 2277 | 3298 |
| hsa-miR-4520a-5p | 2278 | 3299 |
| hsa-miR-4520b-3p | 2279 | 3300 |
| hsa-miR-4520b-5p | 2280 | 3301 |
| hsa-miR-4521 | 2281 | 3302 |
| hsa-miR-4522 | 2282 | 3303 |
| hsa-miR-4523 | 2283 | 3304 |
| hsa-miR-452-3p | 2284 | 3305 |
| hsa-miR-4524a-3p | 2285 | 3306 |
| hsa-miR-4524a-5p | 2286 | 3307 |
| hsa-miR-4524b-3p | 2287 | 3308 |
| hsa-miR-4524b-5p | 2288 | 3309 |
| hsa-miR-4525 | 2289 | 3310 |
| hsa-miR-452-5p | 2290 | 3311 |
| hsa-miR-4526 | 2291 | 3312 |
| hsa-miR-4527 | 2292 | 3313 |
| hsa-miR-4528 | 2293 | 3314 |
| hsa-miR-4529-3p | 2294 | 3315 |
| hsa-miR-4529-5p | 2295 | 3316 |
| hsa-miR-4530 | 2296 | 3317 |
| hsa-miR-4531 | 2297 | 3318 |
| hsa-miR-4532 | 2298 | 3319 |
| hsa-miR-4533 | 2299 | 3320 |
| hsa-miR-4534 | 2300 | 3321 |
| hsa-miR-4535 | 2301 | 3322 |
| hsa-miR-4536-3p | 2302 | 3323 |
| hsa-miR-4536-5p | 2303 | 3324 |
| hsa-miR-4537 | 2304 | 3325 |
| hsa-miR-4538 | 2305 | 3326 |
| hsa-miR-4539 | 2306 | 3327 |
| hsa-miR-4540 | 2307 | 3328 |
| hsa-miR-454-3p | 2308 | 3329 |
| hsa-miR-454-5p | 2309 | 3330 |
| hsa-miR-455-3p | 2310 | 3331 |
| hsa-miR-455-5p | 2311 | 3332 |
| hsa-miR-4632-3p | 2312 | 3333 |
| hsa-miR-4632-5p | 2313 | 3334 |
| hsa-miR-4633-3p | 2314 | 3335 |
| hsa-miR-4633-5p | 2315 | 3336 |
| hsa-miR-4634 | 2316 | 3337 |
| hsa-miR-4635 | 2317 | 3338 |
| hsa-miR-4636 | 2318 | 3339 |
| hsa-miR-4637 | 2319 | 3340 |
| hsa-miR-4638-3p | 2320 | 3341 |
| hsa-miR-4638-5p | 2321 | 3342 |
| hsa-miR-4639-3p | 2322 | 3343 |
| hsa-miR-4639-5p | 2323 | 3344 |
| hsa-miR-4640-3p | 2324 | 3345 |
| hsa-miR-4640-5p | 2325 | 3346 |
| hsa-miR-4641 | 2326 | 3347 |
| hsa-miR-4642 | 2327 | 3348 |
| hsa-miR-4643 | 2328 | 3349 |
| hsa-miR-4644 | 2329 | 3350 |
| hsa-miR-4645-3p | 2330 | 3351 |
| hsa-miR-4645-5p | 2331 | 3352 |
| hsa-miR-4646-3p | 2332 | 3353 |
| hsa-miR-4646-5p | 2333 | 3354 |
| hsa-miR-4647 | 2334 | 3355 |
| hsa-miR-4648 | 2335 | 3356 |
| hsa-miR-4649-3p | 2336 | 3357 |
| hsa-miR-4649-5p | 2337 | 3358 |
| hsa-miR-4650-3p | 2338 | 3359 |
| hsa-miR-4650-5p | 2339 | 3360 |
| hsa-miR-4651 | 2340 | 3361 |
| hsa-miR-4652-3p | 2341 | 3362 |
| hsa-miR-4652-5p | 2342 | 3363 |
| hsa-miR-4653-3p | 2343 | 3364 |
| hsa-miR-4653-5p | 2344 | 3365 |
| hsa-miR-4654 | 2345 | 3366 |
| hsa-miR-4655-3p | 2346 | 3367 |
| hsa-miR-4655-5p | 2347 | 3368 |
| hsa-miR-4656 | 2348 | 3369 |
| hsa-miR-4657 | 2349 | 3370 |
| hsa-miR-4658 | 2350 | 3371 |
| hsa-miR-4659a-3p | 2351 | 3372 |
| hsa-miR-4659a-5p | 2352 | 3373 |

TABLE 11-continued

Mirs and mir binding sites

| microRNA | mir SEQ ID | MIR BS SEQ ID |
|---|---|---|
| hsa-miR-4659b-3p | 2353 | 3374 |
| hsa-miR-4659b-5p | 2354 | 3375 |
| hsa-miR-466 | 2355 | 3376 |
| hsa-miR-4660 | 2356 | 3377 |
| hsa-miR-4661-3p | 2357 | 3378 |
| hsa-miR-4661-5p | 2358 | 3379 |
| hsa-miR-4662a-3p | 2359 | 3380 |
| hsa-miR-4662a-5p | 2360 | 3381 |
| hsa-miR-4662b | 2361 | 3382 |
| hsa-miR-4663 | 2362 | 3383 |
| hsa-miR-4664-3p | 2363 | 3384 |
| hsa-miR-4664-5p | 2364 | 3385 |
| hsa-miR-4665-3p | 2365 | 3386 |
| hsa-miR-4665-5p | 2366 | 3387 |
| hsa-miR-4666a-3p | 2367 | 3388 |
| hsa-miR-4666a-5p | 2368 | 3389 |
| hsa-miR-4666b | 2369 | 3390 |
| hsa-miR-4667-3p | 2370 | 3391 |
| hsa-miR-4667-5p | 2371 | 3392 |
| hsa-miR-4668-3p | 2372 | 3393 |
| hsa-miR-4668-5p | 2373 | 3394 |
| hsa-miR-4669 | 2374 | 3395 |
| hsa-miR-4670-3p | 2375 | 3396 |
| hsa-miR-4670-5p | 2376 | 3397 |
| hsa-miR-4671-3p | 2377 | 3398 |
| hsa-miR-4671-5p | 2378 | 3399 |
| hsa-miR-4672 | 2379 | 3400 |
| hsa-miR-4673 | 2380 | 3401 |
| hsa-miR-4674 | 2381 | 3402 |
| hsa-miR-4675 | 2382 | 3403 |
| hsa-miR-4676-3p | 2383 | 3404 |
| hsa-miR-4676-5p | 2384 | 3405 |
| hsa-miR-4677-3p | 2385 | 3406 |
| hsa-miR-4677-5p | 2386 | 3407 |
| hsa-miR-4678 | 2387 | 3408 |
| hsa-miR-4679 | 2388 | 3409 |
| hsa-miR-4680-3p | 2389 | 3410 |
| hsa-miR-4680-5p | 2390 | 3411 |
| hsa-miR-4681 | 2391 | 3412 |
| hsa-miR-4682 | 2392 | 3413 |
| hsa-miR-4683 | 2393 | 3414 |
| hsa-miR-4684-3p | 2394 | 3415 |
| hsa-miR-4684-5p | 2395 | 3416 |
| hsa-miR-4685-3p | 2396 | 3417 |
| hsa-miR-4685-5p | 2397 | 3418 |
| hsa-miR-4686 | 2398 | 3419 |
| hsa-miR-4687-3p | 2399 | 3420 |
| hsa-miR-4687-5p | 2400 | 3421 |
| hsa-miR-4688 | 2401 | 3422 |
| hsa-miR-4689 | 2402 | 3423 |
| hsa-miR-4690-3p | 2403 | 3424 |
| hsa-miR-4690-5p | 2404 | 3425 |
| hsa-miR-4691-3p | 2405 | 3426 |
| hsa-miR-4691-5p | 2406 | 3427 |
| hsa-miR-4692 | 2407 | 3428 |
| hsa-miR-4693-3p | 2408 | 3429 |
| hsa-miR-4693-5p | 2409 | 3430 |
| hsa-miR-4694-3p | 2410 | 3431 |
| hsa-miR-4694-5p | 2411 | 3432 |
| hsa-miR-4695-3p | 2412 | 3433 |
| hsa-miR-4695-5p | 2413 | 3434 |
| hsa-miR-4696 | 2414 | 3435 |
| hsa-miR-4697-3p | 2415 | 3436 |
| hsa-miR-4697-5p | 2416 | 3437 |
| hsa-miR-4698 | 2417 | 3438 |
| hsa-miR-4699-3p | 2418 | 3439 |
| hsa-miR-4699-5p | 2419 | 3440 |
| hsa-miR-4700-3p | 2420 | 3441 |
| hsa-miR-4700-5p | 2421 | 3442 |
| hsa-miR-4701-3p | 2422 | 3443 |
| hsa-miR-4701-5p | 2423 | 3444 |
| hsa-miR-4703-3p | 2424 | 3445 |
| hsa-miR-4703-5p | 2425 | 3446 |
| hsa-miR-4704-3p | 2426 | 3447 |
| hsa-miR-4704-5p | 2427 | 3448 |
| hsa-miR-4705 | 2428 | 3449 |
| hsa-miR-4706 | 2429 | 3450 |
| hsa-miR-4707-3p | 2430 | 3451 |
| hsa-miR-4707-5p | 2431 | 3452 |
| hsa-miR-4708-3p | 2432 | 3453 |
| hsa-miR-4708-5p | 2433 | 3454 |
| hsa-miR-4709-3p | 2434 | 3455 |
| hsa-miR-4709-5p | 2435 | 3456 |
| hsa-miR-4710 | 2436 | 3457 |
| hsa-miR-4711-3p | 2437 | 3458 |
| hsa-miR-4711-5p | 2438 | 3459 |
| hsa-miR-4712-3p | 2439 | 3460 |
| hsa-miR-4712-5p | 2440 | 3461 |
| hsa-miR-4713-3p | 2441 | 3462 |
| hsa-miR-4713-5p | 2442 | 3463 |
| hsa-miR-4714-3p | 2443 | 3464 |
| hsa-miR-4714-5p | 2444 | 3465 |
| hsa-miR-4715-3p | 2445 | 3466 |
| hsa-miR-4715-5p | 2446 | 3467 |
| hsa-miR-4716-3p | 2447 | 3468 |
| hsa-miR-4716-5p | 2448 | 3469 |
| hsa-miR-4717-3p | 2449 | 3470 |
| hsa-miR-4717-5p | 2450 | 3471 |
| hsa-miR-4718 | 2451 | 3472 |
| hsa-miR-4719 | 2452 | 3473 |
| hsa-miR-4720-3p | 2453 | 3474 |
| hsa-miR-4720-5p | 2454 | 3475 |
| hsa-miR-4721 | 2455 | 3476 |
| hsa-miR-4722-3p | 2456 | 3477 |
| hsa-miR-4722-5p | 2457 | 3478 |
| hsa-miR-4723-3p | 2458 | 3479 |
| hsa-miR-4723-5p | 2459 | 3480 |
| hsa-miR-4724-3p | 2460 | 3481 |
| hsa-miR-4724-5p | 2461 | 3482 |
| hsa-miR-4725-3p | 2462 | 3483 |
| hsa-miR-4725-5p | 2463 | 3484 |
| hsa-miR-4726-3p | 2464 | 3485 |
| hsa-miR-4726-5p | 2465 | 3486 |
| hsa-miR-4727-3p | 2466 | 3487 |
| hsa-miR-4727-5p | 2467 | 3488 |
| hsa-miR-4728-3p | 2468 | 3489 |
| hsa-miR-4728-5p | 2469 | 3490 |
| hsa-miR-4729 | 2470 | 3491 |
| hsa-miR-4730 | 2471 | 3492 |
| hsa-miR-4731-3p | 2472 | 3493 |
| hsa-miR-4731-5p | 2473 | 3494 |
| hsa-miR-4732-3p | 2474 | 3495 |
| hsa-miR-4732-5p | 2475 | 3496 |
| hsa-miR-4733-3p | 2476 | 3497 |
| hsa-miR-4733-5p | 2477 | 3498 |
| hsa-miR-4734 | 2478 | 3499 |
| hsa-miR-4735-3p | 2479 | 3500 |
| hsa-miR-4735-5p | 2480 | 3501 |
| hsa-miR-4736 | 2481 | 3502 |
| hsa-miR-4737 | 2482 | 3503 |
| hsa-miR-4738-3p | 2483 | 3504 |
| hsa-miR-4738-5p | 2484 | 3505 |
| hsa-miR-4739 | 2485 | 3506 |
| hsa-miR-4740-3p | 2486 | 3507 |
| hsa-miR-4740-5p | 2487 | 3508 |
| hsa-miR-4741 | 2488 | 3509 |
| hsa-miR-4742-3p | 2489 | 3510 |
| hsa-miR-4742-5p | 2490 | 3511 |
| hsa-miR-4743-3p | 2491 | 3512 |
| hsa-miR-4743-5p | 2492 | 3513 |
| hsa-miR-4744 | 2493 | 3514 |
| hsa-miR-4745-3p | 2494 | 3515 |
| hsa-miR-4745-5p | 2495 | 3516 |
| hsa-miR-4746-3p | 2496 | 3517 |
| hsa-miR-4746-5p | 2497 | 3518 |
| hsa-miR-4747-3p | 2498 | 3519 |
| hsa-miR-4747-5p | 2499 | 3520 |
| hsa-miR-4748 | 2500 | 3521 |
| hsa-miR-4749-3p | 2501 | 3522 |
| hsa-miR-4749-5p | 2502 | 3523 |

TABLE 11-continued

Mirs and mir binding sites

| microRNA | mir SEQ ID | MIR BS SEQ ID |
|---|---|---|
| hsa-miR-4750-3p | 2503 | 3524 |
| hsa-miR-4750-5p | 2504 | 3525 |
| hsa-miR-4751 | 2505 | 3526 |
| hsa-miR-4752 | 2506 | 3527 |
| hsa-miR-4753-3p | 2507 | 3528 |
| hsa-miR-4753-5p | 2508 | 3529 |
| hsa-miR-4754 | 2509 | 3530 |
| hsa-miR-4755-3p | 2510 | 3531 |
| hsa-miR-4755-5p | 2511 | 3532 |
| hsa-miR-4756-3p | 2512 | 3533 |
| hsa-miR-4756-5p | 2513 | 3534 |
| hsa-miR-4757-3p | 2514 | 3535 |
| hsa-miR-4757-5p | 2515 | 3536 |
| hsa-miR-4758-3p | 2516 | 3537 |
| hsa-miR-4758-5p | 2517 | 3538 |
| hsa-miR-4759 | 2518 | 3539 |
| hsa-miR-4760-3p | 2519 | 3540 |
| hsa-miR-4760-5p | 2520 | 3541 |
| hsa-miR-4761-3p | 2521 | 3542 |
| hsa-miR-4761-5p | 2522 | 3543 |
| hsa-miR-4762-3p | 2523 | 3544 |
| hsa-miR-4762-5p | 2524 | 3545 |
| hsa-miR-4763-3p | 2525 | 3546 |
| hsa-miR-4763-5p | 2526 | 3547 |
| hsa-miR-4764-3p | 2527 | 3548 |
| hsa-miR-4764-5p | 2528 | 3549 |
| hsa-miR-4765 | 2529 | 3550 |
| hsa-miR-4766-3p | 2530 | 3551 |
| hsa-miR-4766-5p | 2531 | 3552 |
| hsa-miR-4767 | 2532 | 3553 |
| hsa-miR-4768-3p | 2533 | 3554 |
| hsa-miR-4768-5p | 2534 | 3555 |
| hsa-miR-4769-3p | 2535 | 3556 |
| hsa-miR-4769-5p | 2536 | 3557 |
| hsa-miR-4770 | 2537 | 3558 |
| hsa-miR-4771 | 2538 | 3559 |
| hsa-miR-4772-3p | 2539 | 3560 |
| hsa-miR-4772-5p | 2540 | 3561 |
| hsa-miR-4773 | 2541 | 3562 |
| hsa-miR-4774-3p | 2542 | 3563 |
| hsa-miR-4774-5p | 2543 | 3564 |
| hsa-miR-4775 | 2544 | 3565 |
| hsa-miR-4776-3p | 2545 | 3566 |
| hsa-miR-4776-5p | 2546 | 3567 |
| hsa-miR-4777-3p | 2547 | 3568 |
| hsa-miR-4777-5p | 2548 | 3569 |
| hsa-miR-4778-3p | 2549 | 3570 |
| hsa-miR-4778-5p | 2550 | 3571 |
| hsa-miR-4779 | 2551 | 3572 |
| hsa-miR-4780 | 2552 | 3573 |
| hsa-miR-4781-3p | 2553 | 3574 |
| hsa-miR-4781-5p | 2554 | 3575 |
| hsa-miR-4782-3p | 2555 | 3576 |
| hsa-miR-4782-5p | 2556 | 3577 |
| hsa-miR-4783-3p | 2557 | 3578 |
| hsa-miR-4783-5p | 2558 | 3579 |
| hsa-miR-4784 | 2559 | 3580 |
| hsa-miR-4785 | 2560 | 3581 |
| hsa-miR-4786-3p | 2561 | 3582 |
| hsa-miR-4786-5p | 2562 | 3583 |
| hsa-miR-4787-3p | 2563 | 3584 |
| hsa-miR-4787-5p | 2564 | 3585 |
| hsa-miR-4788 | 2565 | 3586 |
| hsa-miR-4789-3p | 2566 | 3587 |
| hsa-miR-4789-5p | 2567 | 3588 |
| hsa-miR-4790-3p | 2568 | 3589 |
| hsa-miR-4790-5p | 2569 | 3590 |
| hsa-miR-4791 | 2570 | 3591 |
| hsa-miR-4792 | 2571 | 3592 |
| hsa-miR-4793-3p | 2572 | 3593 |
| hsa-miR-4793-5p | 2573 | 3594 |
| hsa-miR-4794 | 2574 | 3595 |
| hsa-miR-4795-3p | 2575 | 3596 |
| hsa-miR-4795-5p | 2576 | 3597 |
| hsa-miR-4796-3p | 2577 | 3598 |
| hsa-miR-4796-5p | 2578 | 3599 |
| hsa-miR-4797-3p | 2579 | 3600 |
| hsa-miR-4797-5p | 2580 | 3601 |
| hsa-miR-4798-3p | 2581 | 3602 |
| hsa-miR-4798-5p | 2582 | 3603 |
| hsa-miR-4799-3p | 2583 | 3604 |
| hsa-miR-4799-5p | 2584 | 3605 |
| hsa-miR-4800-3p | 2585 | 3606 |
| hsa-miR-4800-5p | 2586 | 3607 |
| hsa-miR-4801 | 2587 | 3608 |
| hsa-miR-4802-3p | 2588 | 3609 |
| hsa-miR-4802-5p | 2589 | 3610 |
| hsa-miR-4803 | 2590 | 3611 |
| hsa-miR-4804-3p | 2591 | 3612 |
| hsa-miR-4804-5p | 2592 | 3613 |
| hsa-miR-483-3p | 2593 | 3614 |
| hsa-miR-483-5p | 2594 | 3615 |
| hsa-miR-484 | 2595 | 3616 |
| hsa-miR-485-3p | 2596 | 3617 |
| hsa-miR-485-5p | 2597 | 3618 |
| hsa-miR-486-3p | 2598 | 3619 |
| hsa-miR-486-5p | 2599 | 3620 |
| hsa-miR-487a | 2600 | 3621 |
| hsa-miR-487b | 2601 | 3622 |
| hsa-miR-488-3p | 2602 | 3623 |
| hsa-miR-488-5p | 2603 | 3624 |
| hsa-miR-489 | 2604 | 3625 |
| hsa-miR-490-3p | 2605 | 3626 |
| hsa-miR-490-5p | 2606 | 3627 |
| hsa-miR-491-3p | 2607 | 3628 |
| hsa-miR-491-5p | 2608 | 3629 |
| hsa-miR-492 | 2609 | 3630 |
| hsa-miR-493-3p | 2610 | 3631 |
| hsa-miR-493-5p | 2611 | 3632 |
| hsa-miR-494 | 2612 | 3633 |
| hsa-miR-495-3p | 2613 | 3634 |
| hsa-miR-495-5p | 2614 | 3635 |
| hsa-miR-496 | 2615 | 3636 |
| hsa-miR-497-3p | 2616 | 3637 |
| hsa-miR-497-5p | 2617 | 3638 |
| hsa-miR-498 | 2618 | 3639 |
| hsa-miR-4999-3p | 2619 | 3640 |
| hsa-miR-4999-5p | 2620 | 3641 |
| hsa-miR-499a-3p | 2621 | 3642 |
| hsa-miR-499a-5p | 2622 | 3643 |
| hsa-miR-499b-3p | 2623 | 3644 |
| hsa-miR-499b-5p | 2624 | 3645 |
| hsa-miR-5000-3p | 2625 | 3646 |
| hsa-miR-5000-5p | 2626 | 3647 |
| hsa-miR-5001-3p | 2627 | 3648 |
| hsa-miR-5001-5p | 2628 | 3649 |
| hsa-miR-5002-3p | 2629 | 3650 |
| hsa-miR-5002-5p | 2630 | 3651 |
| hsa-miR-5003-3p | 2631 | 3652 |
| hsa-miR-5003-5p | 2632 | 3653 |
| hsa-miR-5004-3p | 2633 | 3654 |
| hsa-miR-5004-5p | 2634 | 3655 |
| hsa-miR-5006-3p | 2635 | 3656 |
| hsa-miR-5006-5p | 2636 | 3657 |
| hsa-miR-5007-3p | 2637 | 3658 |
| hsa-miR-5007-5p | 2638 | 3659 |
| hsa-miR-5008-3p | 2639 | 3660 |
| hsa-miR-5008-5p | 2640 | 3661 |
| hsa-miR-5009-3p | 2641 | 3662 |
| hsa-miR-5009-5p | 2642 | 3663 |
| hsa-miR-500a-3p | 2643 | 3664 |
| hsa-miR-500a-5p | 2644 | 3665 |
| hsa-miR-500b | 2645 | 3666 |
| hsa-miR-5010-3p | 2646 | 3667 |
| hsa-miR-5010-5p | 2647 | 3668 |
| hsa-miR-5011-3p | 2648 | 3669 |
| hsa-miR-5011-5p | 2649 | 3670 |
| hsa-miR-501-3p | 2650 | 3671 |
| hsa-miR-501-5p | 2651 | 3672 |
| hsa-miR-502-3p | 2652 | 3673 |

TABLE 11-continued

Mirs and mir binding sites

| microRNA | mir SEQ ID | MIR BS SEQ ID |
|---|---|---|
| hsa-miR-502-5p | 2653 | 3674 |
| hsa-miR-503-3p | 2654 | 3675 |
| hsa-miR-503-5p | 2655 | 3676 |
| hsa-miR-504 | 2656 | 3677 |
| hsa-miR-5047 | 2657 | 3678 |
| hsa-miR-505-3p | 2658 | 3679 |
| hsa-miR-505-5p | 2659 | 3680 |
| hsa-miR-506-3p | 2660 | 3681 |
| hsa-miR-506-5p | 2661 | 3682 |
| hsa-miR-507 | 2662 | 3683 |
| hsa-miR-508-3p | 2663 | 3684 |
| hsa-miR-508-5p | 2664 | 3685 |
| hsa-miR-5087 | 2665 | 3686 |
| hsa-miR-5088 | 2666 | 3687 |
| hsa-miR-5089-3p | 2667 | 3688 |
| hsa-miR-5089-5p | 2668 | 3689 |
| hsa-miR-5090 | 2669 | 3690 |
| hsa-miR-5091 | 2670 | 3691 |
| hsa-miR-5092 | 2671 | 3692 |
| hsa-miR-5093 | 2672 | 3693 |
| hsa-miR-509-3-5p | 2673 | 3694 |
| hsa-miR-509-3p | 2674 | 3695 |
| hsa-miR-5094 | 2675 | 3696 |
| hsa-miR-5095 | 2676 | 3697 |
| hsa-miR-509-5p | 2677 | 3698 |
| hsa-miR-5096 | 2678 | 3699 |
| hsa-miR-510 | 2679 | 3700 |
| hsa-miR-5100 | 2680 | 3701 |
| hsa-miR-511 | 2681 | 3702 |
| hsa-miR-512-3p | 2682 | 3703 |
| hsa-miR-512-5p | 2683 | 3704 |
| hsa-miR-513a-3p | 2684 | 3705 |
| hsa-miR-513a-5p | 2685 | 3706 |
| hsa-miR-513b | 2686 | 3707 |
| hsa-miR-513c-3p | 2687 | 3708 |
| hsa-miR-513c-5p | 2688 | 3709 |
| hsa-miR-514a-3p | 2689 | 3710 |
| hsa-miR-514a-5p | 2690 | 3711 |
| hsa-miR-514b-3p | 2691 | 3712 |
| hsa-miR-514b-5p | 2692 | 3713 |
| hsa-miR-515-3p | 2693 | 3714 |
| hsa-miR-515-5p | 2694 | 3715 |
| hsa-miR-516a-3p | 2695 | 3716 |
| hsa-miR-516a-5p | 2696 | 3717 |
| hsa-miR-516b-3p | 2697 | 3718 |
| hsa-miR-516b-5p | 2698 | 3719 |
| hsa-miR-517-5p | 2699 | 3720 |
| hsa-miR-517a-3p | 2700 | 3721 |
| hsa-miR-517b-3p | 2701 | 3722 |
| hsa-miR-517c-3p | 2702 | 3723 |
| hsa-miR-5186 | 2703 | 3724 |
| hsa-miR-5187-3p | 2704 | 3725 |
| hsa-miR-5187-5p | 2705 | 3726 |
| hsa-miR-5188 | 2706 | 3727 |
| hsa-miR-5189 | 2707 | 3728 |
| hsa-miR-518a-3p | 2708 | 3729 |
| hsa-miR-518a-5p | 2709 | 3730 |
| hsa-miR-518b | 2710 | 3731 |
| hsa-miR-518c-3p | 2711 | 3732 |
| hsa-miR-518c-5p | 2712 | 3733 |
| hsa-miR-518d-3p | 2713 | 3734 |
| hsa-miR-518d-5p | 2714 | 3735 |
| hsa-miR-518e-3p | 2715 | 3736 |
| hsa-miR-518e-5p | 2716 | 3737 |
| hsa-miR-518f-3p | 2717 | 3738 |
| hsa-miR-518f-5p | 2718 | 3739 |
| hsa-miR-5190 | 2719 | 3740 |
| hsa-miR-5191 | 2720 | 3741 |
| hsa-miR-5192 | 2721 | 3742 |
| hsa-miR-5193 | 2722 | 3743 |
| hsa-miR-5194 | 2723 | 3744 |
| hsa-miR-5195-3p | 2724 | 3745 |
| hsa-miR-5195-5p | 2725 | 3746 |
| hsa-miR-5196-3p | 2726 | 3747 |
| hsa-miR-5196-5p | 2727 | 3748 |
| hsa-miR-5197-3p | 2728 | 3749 |
| hsa-miR-5197-5p | 2729 | 3750 |
| hsa-miR-519a-3p | 2730 | 3751 |
| hsa-miR-519a-5p | 2731 | 3752 |
| hsa-miR-519b-3p | 2732 | 3753 |
| hsa-miR-519b-5p | 2733 | 3754 |
| hsa-miR-519c-3p | 2734 | 3755 |
| hsa-miR-519c-5p | 2735 | 3756 |
| hsa-miR-519d | 2736 | 3757 |
| hsa-miR-519e-3p | 2737 | 3758 |
| hsa-miR-519e-5p | 2738 | 3759 |
| hsa-miR-520a-3p | 2739 | 3760 |
| hsa-miR-520a-5p | 2740 | 3761 |
| hsa-miR-520b | 2741 | 3762 |
| hsa-miR-520c-3p | 2742 | 3763 |
| hsa-miR-520c-5p | 2743 | 3764 |
| hsa-miR-520d-3p | 2744 | 3765 |
| hsa-miR-520d-5p | 2745 | 3766 |
| hsa-miR-520e | 2746 | 3767 |
| hsa-miR-520f | 2747 | 3768 |
| hsa-miR-520g | 2748 | 3769 |
| hsa-miR-520h | 2749 | 3770 |
| hsa-miR-521 | 2750 | 3771 |
| hsa-miR-522-3p | 2751 | 3772 |
| hsa-miR-522-5p | 2752 | 3773 |
| hsa-miR-523-3p | 2753 | 3774 |
| hsa-miR-523-5p | 2754 | 3775 |
| hsa-miR-524-3p | 2755 | 3776 |
| hsa-miR-524-5p | 2756 | 3777 |
| hsa-miR-525-3p | 2757 | 3778 |
| hsa-miR-525-5p | 2758 | 3779 |
| hsa-miR-526a | 2759 | 3780 |
| hsa-miR-526b-3p | 2760 | 3781 |
| hsa-miR-526b-5p | 2761 | 3782 |
| hsa-miR-527 | 2762 | 3783 |
| hsa-miR-532-3p | 2763 | 3784 |
| hsa-miR-532-5p | 2764 | 3785 |
| hsa-miR-539-3p | 2765 | 3786 |
| hsa-miR-539-5p | 2766 | 3787 |
| hsa-miR-541-3p | 2767 | 3788 |
| hsa-miR-541-5p | 2768 | 3789 |
| hsa-miR-542-3p | 2769 | 3790 |
| hsa-miR-542-5p | 2770 | 3791 |
| hsa-miR-543 | 2771 | 3792 |
| hsa-miR-544a | 2772 | 3793 |
| hsa-miR-544b | 2773 | 3794 |
| hsa-miR-545-3p | 2774 | 3795 |
| hsa-miR-545-5p | 2775 | 3796 |
| hsa-miR-548 | 2776 | 3797 |
| hsa-miR-548-3p | 2777 | 3798 |
| hsa-miR-548-5p | 2778 | 3799 |
| hsa-miR-548a | 2779 | 3800 |
| hsa-miR-548a-3p | 2780 | 3801 |
| hsa-miR-548a-5p | 2781 | 3802 |
| hsa-miR-548aa | 2782 | 3803 |
| hsa-miR-548ab | 2783 | 3804 |
| hsa-miR-548ac | 2784 | 3805 |
| hsa-miR-548ad | 2785 | 3806 |
| hsa-miR-548ae | 2786 | 3807 |
| hsa-miR-548ag | 2787 | 3808 |
| hsa-miR-548ah-3p | 2788 | 3809 |
| hsa-miR-548ah-5p | 2789 | 3810 |
| hsa-miR-548ai | 2790 | 3811 |
| hsa-miR-548aj-3p | 2791 | 3812 |
| hsa-miR-548aj-5p | 2792 | 3813 |
| hsa-miR-548ak | 2793 | 3814 |
| hsa-miR-548al | 2794 | 3815 |
| hsa-miR-548am-3p | 2795 | 3816 |
| hsa-miR-548am-5p | 2796 | 3817 |
| hsa-miR-548an | 2797 | 3818 |
| hsa-miR-548ao-3p | 2798 | 3819 |
| hsa-miR-548ao-5p | 2799 | 3820 |
| hsa-miR-548ap-3p | 2800 | 3821 |
| hsa-miR-548ap-5p | 2801 | 3822 |
| hsa-miR-548aq-3p | 2802 | 3823 |

TABLE 11-continued

Mirs and mir binding sites

| microRNA | mir SEQ ID | MIR BS SEQ ID |
|---|---|---|
| hsa-miR-548aq-5p | 2803 | 3824 |
| hsa-miR-548ar-3p | 2804 | 3825 |
| hsa-miR-548ar-5p | 2805 | 3826 |
| hsa-miR-548as-3p | 2806 | 3827 |
| hsa-miR-548as-5p | 2807 | 3828 |
| hsa-miR-548at-3p | 2808 | 3829 |
| hsa-miR-548at-5p | 2809 | 3830 |
| hsa-miR-548au-3p | 2810 | 3831 |
| hsa-miR-548au-5p | 2811 | 3832 |
| hsa-miR-548av-3p | 2812 | 3833 |
| hsa-miR-548av-5p | 2813 | 3834 |
| hsa-miR-548aw | 2814 | 3835 |
| hsa-miR-548ay-3p | 2815 | 3836 |
| hsa-miR-548ay-5p | 2816 | 3837 |
| hsa-miR-548az-3p | 2817 | 3838 |
| hsa-miR-548az-5p | 2818 | 3839 |
| hsa-miR-548b-3p | 2819 | 3840 |
| hsa-miR-548b-5p | 2820 | 3841 |
| hsa-miR-548c-3p | 2821 | 3842 |
| hsa-miR-548c-5p | 2822 | 3843 |
| hsa-miR-548d-3p | 2823 | 3844 |
| hsa-miR-548d-5p | 2824 | 3845 |
| hsa-miR-548e | 2825 | 3846 |
| hsa-miR-548f | 2826 | 3847 |
| hsa-miR-548g-3p | 2827 | 3848 |
| hsa-miR-548g-5p | 2828 | 3849 |
| hsa-miR-548h-3p | 2829 | 3850 |
| hsa-miR-548h-5p | 2830 | 3851 |
| hsa-miR-548i | 2831 | 3852 |
| hsa-miR-548j | 2832 | 3853 |
| hsa-miR-548k | 2833 | 3854 |
| hsa-miR-548l | 2834 | 3855 |
| hsa-miR-548m | 2835 | 3856 |
| hsa-miR-548n | 2836 | 3857 |
| hsa-miR-548o-3p | 2837 | 3858 |
| hsa-miR-548o-5p | 2838 | 3859 |
| hsa-miR-548p | 2839 | 3860 |
| hsa-miR-548q | 2840 | 3861 |
| hsa-miR-548s | 2841 | 3862 |
| hsa-miR-548t-3p | 2842 | 3863 |
| hsa-miR-548t-5p | 2843 | 3864 |
| hsa-miR-548u | 2844 | 3865 |
| hsa-miR-548w | 2845 | 3866 |
| hsa-miR-548y | 2846 | 3867 |
| hsa-miR-548z | 2847 | 3868 |
| hsa-miR-549a | 2848 | 3869 |
| hsa-miR-550a-3-5p | 2849 | 3870 |
| hsa-miR-550a-3p | 2850 | 3871 |
| hsa-miR-550a-5p | 2851 | 3872 |
| hsa-miR-550b-2-5p | 2852 | 3873 |
| hsa-miR-550b-3p | 2853 | 3874 |
| hsa-miR-551a | 2854 | 3875 |
| hsa-miR-551b-3p | 2855 | 3876 |
| hsa-miR-551b-5p | 2856 | 3877 |
| hsa-miR-552 | 2857 | 3878 |
| hsa-miR-553 | 2858 | 3879 |
| hsa-miR-554 | 2859 | 3880 |
| hsa-miR-555 | 2860 | 3881 |
| hsa-miR-556-3p | 2861 | 3882 |
| hsa-miR-556-5p | 2862 | 3883 |
| hsa-miR-557 | 2863 | 3884 |
| hsa-miR-5571-3p | 2864 | 3885 |
| hsa-miR-5571-5p | 2865 | 3886 |
| hsa-miR-5572 | 2866 | 3887 |
| hsa-miR-5579-3p | 2867 | 3888 |
| hsa-miR-5579-5p | 2868 | 3889 |
| hsa-miR-558 | 2869 | 3890 |
| hsa-miR-5580-3p | 2870 | 3891 |
| hsa-miR-5580-5p | 2871 | 3892 |
| hsa-miR-5581-3p | 2872 | 3893 |
| hsa-miR-5581-5p | 2873 | 3894 |
| hsa-miR-5582-3p | 2874 | 3895 |
| hsa-miR-5582-5p | 2875 | 3896 |
| hsa-miR-5583-3p | 2876 | 3897 |
| hsa-miR-5583-5p | 2877 | 3898 |
| hsa-miR-5584-3p | 2878 | 3899 |
| hsa-miR-5584-5p | 2879 | 3900 |
| hsa-miR-5585-3p | 2880 | 3901 |
| hsa-miR-5585-5p | 2881 | 3902 |
| hsa-miR-5586-3p | 2882 | 3903 |
| hsa-miR-5586-5p | 2883 | 3904 |
| hsa-miR-5587-3p | 2884 | 3905 |
| hsa-miR-5587-5p | 2885 | 3906 |
| hsa-miR-5588-3p | 2886 | 3907 |
| hsa-miR-5588-5p | 2887 | 3908 |
| hsa-miR-5589-3p | 2888 | 3909 |
| hsa-miR-5589-5p | 2889 | 3910 |
| hsa-miR-559 | 2890 | 3911 |
| hsa-miR-5590-3p | 2891 | 3912 |
| hsa-miR-5590-5p | 2892 | 3913 |
| hsa-miR-5591-3p | 2893 | 3914 |
| hsa-miR-5591-5p | 2894 | 3915 |
| hsa-miR-561-3p | 2895 | 3916 |
| hsa-miR-561-5p | 2896 | 3917 |
| hsa-miR-562 | 2897 | 3918 |
| hsa-miR-563 | 2898 | 3919 |
| hsa-miR-564 | 2899 | 3920 |
| hsa-miR-566 | 2900 | 3921 |
| hsa-miR-567 | 2901 | 3922 |
| hsa-miR-568 | 2902 | 3923 |
| hsa-miR-5680 | 2903 | 3924 |
| hsa-miR-5681a | 2904 | 3925 |
| hsa-miR-5681b | 2905 | 3926 |
| hsa-miR-5682 | 2906 | 3927 |
| hsa-miR-5683 | 2907 | 3928 |
| hsa-miR-5684 | 2908 | 3929 |
| hsa-miR-5685 | 2909 | 3930 |
| hsa-miR-5686 | 2910 | 3931 |
| hsa-miR-5687 | 2911 | 3932 |
| hsa-miR-5688 | 2912 | 3933 |
| hsa-miR-5689 | 2913 | 3934 |
| hsa-miR-569 | 2914 | 3935 |
| hsa-miR-5690 | 2915 | 3936 |
| hsa-miR-5691 | 2916 | 3937 |
| hsa-miR-5692a | 2917 | 3938 |
| hsa-miR-5692b | 2918 | 3939 |
| hsa-miR-5692c | 2919 | 3940 |
| hsa-miR-5693 | 2920 | 3941 |
| hsa-miR-5694 | 2921 | 3942 |
| hsa-miR-5695 | 2922 | 3943 |
| hsa-miR-5696 | 2923 | 3944 |
| hsa-miR-5697 | 2924 | 3945 |
| hsa-miR-5698 | 2925 | 3946 |
| hsa-miR-5699 | 2926 | 3947 |
| hsa-miR-5700 | 2927 | 3948 |
| hsa-miR-5701 | 2928 | 3949 |
| hsa-miR-5702 | 2929 | 3950 |
| hsa-miR-5703 | 2930 | 3951 |
| hsa-miR-570-3p | 2931 | 3952 |
| hsa-miR-5704 | 2932 | 3953 |
| hsa-miR-5705 | 2933 | 3954 |
| hsa-miR-570-5p | 2934 | 3955 |
| hsa-miR-5706 | 2935 | 3956 |
| hsa-miR-5707 | 2936 | 3957 |
| hsa-miR-5708 | 2937 | 3958 |
| hsa-miR-571 | 2938 | 3959 |
| hsa-miR-572 | 2939 | 3960 |
| hsa-miR-573 | 2940 | 3961 |
| hsa-miR-5739 | 2941 | 3962 |
| hsa-miR-574-3p | 2942 | 3963 |
| hsa-miR-574-5p | 2943 | 3964 |
| hsa-miR-575 | 2944 | 3965 |
| hsa-miR-576-3p | 2945 | 3966 |
| hsa-miR-576-5p | 2946 | 3967 |
| hsa-miR-577 | 2947 | 3968 |
| hsa-miR-578 | 2948 | 3969 |
| hsa-miR-5787 | 2949 | 3970 |
| hsa-miR-579 | 2950 | 3971 |
| hsa-miR-580 | 2951 | 3972 |
| hsa-miR-581 | 2952 | 3973 |

TABLE 11-continued

Mirs and mir binding sites

| microRNA | mir SEQ ID | MIR BS SEQ ID |
|---|---|---|
| hsa-miR-582-3p | 2953 | 3974 |
| hsa-miR-582-5p | 2954 | 3975 |
| hsa-miR-583 | 2955 | 3976 |
| hsa-miR-584-3p | 2956 | 3977 |
| hsa-miR-584-5p | 2957 | 3978 |
| hsa-miR-585 | 2958 | 3979 |
| hsa-miR-586 | 2959 | 3980 |
| hsa-miR-587 | 2960 | 3981 |
| hsa-miR-588 | 2961 | 3982 |
| hsa-miR-589-3p | 2962 | 3983 |
| hsa-miR-589-5p | 2963 | 3984 |
| hsa-miR-590-3p | 2964 | 3985 |
| hsa-miR-590-5p | 2965 | 3986 |
| hsa-miR-591 | 2966 | 3987 |
| hsa-miR-592 | 2967 | 3988 |
| hsa-miR-593-3p | 2968 | 3989 |
| hsa-miR-593-5p | 2969 | 3990 |
| hsa-miR-595 | 2970 | 3991 |
| hsa-miR-596 | 2971 | 3992 |
| hsa-miR-597 | 2972 | 3993 |
| hsa-miR-598 | 2973 | 3994 |
| hsa-miR-599 | 2974 | 3995 |
| hsa-miR-600 | 2975 | 3996 |
| hsa-miR-601 | 2976 | 3997 |
| hsa-miR-602 | 2977 | 3998 |
| hsa-miR-603 | 2978 | 3999 |
| hsa-miR-604 | 2979 | 4000 |
| hsa-miR-605 | 2980 | 4001 |
| hsa-miR-606 | 2981 | 4002 |
| hsa-miR-6068 | 2982 | 4003 |
| hsa-miR-6069 | 2983 | 4004 |
| hsa-miR-607 | 2984 | 4005 |
| hsa-miR-6070 | 2985 | 4006 |
| hsa-miR-6071 | 2986 | 4007 |
| hsa-miR-6072 | 2987 | 4008 |
| hsa-miR-6073 | 2988 | 4009 |
| hsa-miR-6074 | 2989 | 4010 |
| hsa-miR-6075 | 2990 | 4011 |
| hsa-miR-6076 | 2991 | 4012 |
| hsa-miR-6077 | 2992 | 4013 |
| hsa-miR-6078 | 2993 | 4014 |
| hsa-miR-6079 | 2994 | 4015 |
| hsa-miR-608 | 2995 | 4016 |
| hsa-miR-6080 | 2996 | 4017 |
| hsa-miR-6081 | 2997 | 4018 |
| hsa-miR-6082 | 2998 | 4019 |
| hsa-miR-6083 | 2999 | 4020 |
| hsa-miR-6084 | 3000 | 4021 |
| hsa-miR-6085 | 3001 | 4022 |
| hsa-miR-6086 | 3002 | 4023 |
| hsa-miR-6087 | 3003 | 4024 |
| hsa-miR-6088 | 3004 | 4025 |
| hsa-miR-6089 | 3005 | 4026 |
| hsa-miR-609 | 3006 | 4027 |
| hsa-miR-6090 | 3007 | 4028 |
| hsa-miR-610 | 3008 | 4029 |
| hsa-miR-611 | 3009 | 4030 |
| hsa-miR-612 | 3010 | 4031 |
| hsa-miR-6124 | 3011 | 4032 |
| hsa-miR-6125 | 3012 | 4033 |
| hsa-miR-6126 | 3013 | 4034 |
| hsa-miR-6127 | 3014 | 4035 |
| hsa-miR-6128 | 3015 | 4036 |
| hsa-miR-6129 | 3016 | 4037 |
| hsa-miR-613 | 3017 | 4038 |
| hsa-miR-6130 | 3018 | 4039 |
| hsa-miR-6131 | 3019 | 4040 |
| hsa-miR-6132 | 3020 | 4041 |
| hsa-miR-6133 | 3021 | 4042 |
| hsa-miR-6134 | 3022 | 4043 |
| hsa-miR-614 | 3023 | 4044 |
| hsa-miR-615-3p | 3024 | 4045 |
| hsa-miR-615-5p | 3025 | 4046 |
| hsa-miR-616-3p | 3026 | 4047 |
| hsa-miR-6165 | 3027 | 4048 |
| hsa-miR-616-5p | 3028 | 4049 |
| hsa-miR-617 | 3029 | 4050 |
| hsa-miR-618 | 3030 | 4051 |
| hsa-miR-619 | 3031 | 4052 |
| hsa-miR-620 | 3032 | 4053 |
| hsa-miR-621 | 3033 | 4054 |
| hsa-miR-622 | 3034 | 4055 |
| hsa-miR-623 | 3035 | 4056 |
| hsa-miR-624-3p | 3036 | 4057 |
| hsa-miR-624-5p | 3037 | 4058 |
| hsa-miR-625-3p | 3038 | 4059 |
| hsa-miR-625-5p | 3039 | 4060 |
| hsa-miR-626 | 3040 | 4061 |
| hsa-miR-627 | 3041 | 4062 |
| hsa-miR-628-3p | 3042 | 4063 |
| hsa-miR-628-5p | 3043 | 4064 |
| hsa-miR-629-3p | 3044 | 4065 |
| hsa-miR-629-5p | 3045 | 4066 |
| hsa-miR-630 | 3046 | 4067 |
| hsa-miR-631 | 3047 | 4068 |
| hsa-miR-632 | 3048 | 4069 |
| hsa-miR-633 | 3049 | 4070 |
| hsa-miR-634 | 3050 | 4071 |
| hsa-miR-635 | 3051 | 4072 |
| hsa-miR-636 | 3052 | 4073 |
| hsa-miR-637 | 3053 | 4074 |
| hsa-miR-638 | 3054 | 4075 |
| hsa-miR-639 | 3055 | 4076 |
| hsa-miR-640 | 3056 | 4077 |
| hsa-miR-641 | 3057 | 4078 |
| hsa-miR-642a-3p | 3058 | 4079 |
| hsa-miR-642a-5p | 3059 | 4080 |
| hsa-miR-642b-3p | 3060 | 4081 |
| hsa-miR-642b-5p | 3061 | 4082 |
| hsa-miR-643 | 3062 | 4083 |
| hsa-miR-644a | 3063 | 4084 |
| hsa-miR-645 | 3064 | 4085 |
| hsa-miR-646 | 3065 | 4086 |
| hsa-miR-647 | 3066 | 4087 |
| hsa-miR-648 | 3067 | 4088 |
| hsa-miR-649 | 3068 | 4089 |
| hsa-miR-6499-3p | 3069 | 4090 |
| hsa-miR-6499-5p | 3070 | 4091 |
| hsa-miR-650 | 3071 | 4092 |
| hsa-miR-6500-3p | 3072 | 4093 |
| hsa-miR-6500-5p | 3073 | 4094 |
| hsa-miR-6501-3p | 3074 | 4095 |
| hsa-miR-6501-5p | 3075 | 4096 |
| hsa-miR-6502-3p | 3076 | 4097 |
| hsa-miR-6502-5p | 3077 | 4098 |
| hsa-miR-6503-3p | 3078 | 4099 |
| hsa-miR-6503-5p | 3079 | 4100 |
| hsa-miR-6504-3p | 3080 | 4101 |
| hsa-miR-6504-5p | 3081 | 4102 |
| hsa-miR-6505-3p | 3082 | 4103 |
| hsa-miR-6505-5p | 3083 | 4104 |
| hsa-miR-6506-3p | 3084 | 4105 |
| hsa-miR-6506-5p | 3085 | 4106 |
| hsa-miR-6507-3p | 3086 | 4107 |
| hsa-miR-6507-5p | 3087 | 4108 |
| hsa-miR-6508-3p | 3088 | 4109 |
| hsa-miR-6508-5p | 3089 | 4110 |
| hsa-miR-6509-3p | 3090 | 4111 |
| hsa-miR-6509-5p | 3091 | 4112 |
| hsa-miR-651 | 3092 | 4113 |
| hsa-miR-6510-3p | 3093 | 4114 |
| hsa-miR-6510-5p | 3094 | 4115 |
| hsa-miR-6511a-3p | 3095 | 4116 |
| hsa-miR-6511a-5p | 3096 | 4117 |
| hsa-miR-6511b-3p | 3097 | 4118 |
| hsa-miR-6511b-5p | 3098 | 4119 |
| hsa-miR-6512-3p | 3099 | 4120 |
| hsa-miR-6512-5p | 3100 | 4121 |
| hsa-miR-6513-3p | 3101 | 4122 |
| hsa-miR-6513-5p | 3102 | 4123 |

TABLE 11-continued

Mirs and mir binding sites

| microRNA | mir SEQ ID | MIR BS SEQ ID |
|---|---|---|
| hsa-miR-6514-3p | 3103 | 4124 |
| hsa-miR-6514-5p | 3104 | 4125 |
| hsa-miR-6515-3p | 3105 | 4126 |
| hsa-miR-6515-5p | 3106 | 4127 |
| hsa-miR-652-3p | 3107 | 4128 |
| hsa-miR-652-5p | 3108 | 4129 |
| hsa-miR-653 | 3109 | 4130 |
| hsa-miR-654-3p | 3110 | 4131 |
| hsa-miR-654-5p | 3111 | 4132 |
| hsa-miR-655 | 3112 | 4133 |
| hsa-miR-656 | 3113 | 4134 |
| hsa-miR-657 | 3114 | 4135 |
| hsa-miR-658 | 3115 | 4136 |
| hsa-miR-659-3p | 3116 | 4137 |
| hsa-miR-659-5p | 3117 | 4138 |
| hsa-miR-660-3p | 3118 | 4139 |
| hsa-miR-660-5p | 3119 | 4140 |
| hsa-miR-661 | 3120 | 4141 |
| hsa-miR-662 | 3121 | 4142 |
| hsa-miR-663a | 3122 | 4143 |
| hsa-miR-663b | 3123 | 4144 |
| hsa-miR-664a-3p | 3124 | 4145 |
| hsa-miR-664a-5p | 3125 | 4146 |
| hsa-miR-664b-3p | 3126 | 4147 |
| hsa-miR-664b-5p | 3127 | 4148 |
| hsa-miR-665 | 3128 | 4149 |
| hsa-miR-668 | 3129 | 4150 |
| hsa-miR-670 | 3130 | 4151 |
| hsa-miR-671-3p | 3131 | 4152 |
| hsa-miR-6715a-3p | 3132 | 4153 |
| hsa-miR-6715b-3p | 3133 | 4154 |
| hsa-miR-6715b-5p | 3134 | 4155 |
| hsa-miR-671-5p | 3135 | 4156 |
| hsa-miR-6716-3p | 3136 | 4157 |
| hsa-miR-6716-5p | 3137 | 4158 |
| hsa-miR-6717-5p | 3138 | 4159 |
| hsa-miR-6718-5p | 3139 | 4160 |
| hsa-miR-6719-3p | 3140 | 4161 |
| hsa-miR-6720-3p | 3141 | 4162 |
| hsa-miR-6721-5p | 3142 | 4163 |
| hsa-miR-6722-3p | 3143 | 4164 |
| hsa-miR-6722-5p | 3144 | 4165 |
| hsa-miR-6723-5p | 3145 | 4166 |
| hsa-miR-6724-5p | 3146 | 4167 |
| hsa-miR-675-3p | 3147 | 4168 |
| hsa-miR-675-5p | 3148 | 4169 |
| hsa-miR-676-3p | 3149 | 4170 |
| hsa-miR-676-5p | 3150 | 4171 |
| hsa-miR-708-3p | 3151 | 4172 |
| hsa-miR-708-5p | 3152 | 4173 |
| hsa-miR-711 | 3153 | 4174 |
| hsa-miR-7-1-3p | 3154 | 4175 |
| hsa-miR-718 | 3155 | 4176 |
| hsa-miR-7-2-3p | 3156 | 4177 |
| hsa-miR-744-3p | 3157 | 4178 |
| hsa-miR-744-5p | 3158 | 4179 |
| hsa-miR-758-3p | 3159 | 4180 |
| hsa-miR-758-5p | 3160 | 4181 |
| hsa-miR-759 | 3161 | 4182 |
| hsa-miR-7-5p | 3162 | 4183 |
| hsa-miR-760 | 3163 | 4184 |
| hsa-miR-761 | 3164 | 4185 |
| hsa-miR-762 | 3165 | 4186 |
| hsa-miR-764 | 3166 | 4187 |
| hsa-miR-765 | 3167 | 4188 |
| hsa-miR-766-3p | 3168 | 4189 |
| hsa-miR-766-5p | 3169 | 4190 |
| hsa-miR-767-3p | 3170 | 4191 |
| hsa-miR-767-5p | 3171 | 4192 |
| hsa-miR-769-3p | 3172 | 4193 |
| hsa-miR-769-5p | 3173 | 4194 |
| hsa-miR-770-5p | 3174 | 4195 |
| hsa-miR-802 | 3175 | 4196 |
| hsa-miR-873-3p | 3176 | 4197 |
| hsa-miR-873-5p | 3177 | 4198 |
| hsa-miR-874 | 3178 | 4199 |
| hsa-miR-875-3p | 3179 | 4200 |
| hsa-miR-875-5p | 3180 | 4201 |
| hsa-miR-876-3p | 3181 | 4202 |
| hsa-miR-876-5p | 3182 | 4203 |
| hsa-miR-877-3p | 3183 | 4204 |
| hsa-miR-877-5p | 3184 | 4205 |
| hsa-miR-885-3p | 3185 | 4206 |
| hsa-miR-885-5p | 3186 | 4207 |
| hsa-miR-887 | 3187 | 4208 |
| hsa-miR-888-3p | 3188 | 4209 |
| hsa-miR-888-5p | 3189 | 4210 |
| hsa-miR-889 | 3190 | 4211 |
| hsa-miR-890 | 3191 | 4212 |
| hsa-miR-891a | 3192 | 4213 |
| hsa-miR-891b | 3193 | 4214 |
| hsa-miR-892a | 3194 | 4215 |
| hsa-miR-892b | 3195 | 4216 |
| hsa-miR-892c-3p | 3196 | 4217 |
| hsa-miR-892c-5p | 3197 | 4218 |
| hsa-miR-920 | 3198 | 4219 |
| hsa-miR-921 | 3199 | 4220 |
| hsa-miR-922 | 3200 | 4221 |
| hsa-miR-924 | 3201 | 4222 |
| hsa-miR-92a-1-5p | 3202 | 4223 |
| hsa-miR-92a-2-5p | 3203 | 4224 |
| hsa-miR-92a-3p | 3204 | 4225 |
| hsa-miR-92b-3p | 3205 | 4226 |
| hsa-miR-92b-5p | 3206 | 4227 |
| hsa-miR-933 | 3207 | 4228 |
| hsa-miR-93-3p | 3208 | 4229 |
| hsa-miR-934 | 3209 | 4230 |
| hsa-miR-935 | 3210 | 4231 |
| hsa-miR-93-5p | 3211 | 4232 |
| hsa-miR-936 | 3212 | 4233 |
| hsa-miR-937-3p | 3213 | 4234 |
| hsa-miR-937-5p | 3214 | 4235 |
| hsa-miR-938 | 3215 | 4236 |
| hsa-miR-939-3p | 3216 | 4237 |
| hsa-miR-939-5p | 3217 | 4238 |
| hsa-miR-9-3p | 3218 | 4239 |
| hsa-miR-940 | 3219 | 4240 |
| hsa-miR-941 | 3220 | 4241 |
| hsa-miR-942 | 3221 | 4242 |
| hsa-miR-943 | 3222 | 4243 |
| hsa-miR-944 | 3223 | 4244 |
| hsa-miR-95 | 3224 | 4245 |
| hsa-miR-9-5p | 3225 | 4246 |
| hsa-miR-96-3p | 3226 | 4247 |
| hsa-miR-96-5p | 3227 | 4248 |
| hsa-miR-98-3p | 3228 | 4249 |
| hsa-miR-98-5p | 3229 | 4250 |
| hsa-miR-99a-3p | 3230 | 4251 |
| hsa-miR-99a-5p | 3231 | 4252 |
| hsa-miR-99b-3p | 3232 | 4253 |
| hsa-miR-99b-5p | 3233 | 4254 |

As shown in Table 12, microRNAs are differentially expressed in different tissues and cells, and often associated with different types of diseases (e.g. cancer cells). The decision of removal or insertion of microRNA binding sites, or any combination, is dependent on microRNA expression patterns and their profilings in cancer cells. In Table 12, "HCC" represents hepatocellular carcinoma, "ALL" stands for acute lymphoblastsic leukemia, "RCC" stands for renal cell carcinoma, "CLL" stands for chrominc lymphocytic leukemia and "MALT" stands for mucosa-associated lymphoid tissue.

TABLE 12 mirs, tissues/cell expression and diseases

| microRNA | mir SEQ ID | BS SEQ ID | Tissues/cells | Associated disease | Biological function |
|---|---|---|---|---|---|
| hsa-let-7a-2-3p | 171 | 1192 | Embryonic stem cells, lung, myeloid cells | inflammatory, various cancers (lung, cervical, breast, pancreatic, etc) | tumor suppressor, |
| hsa-let-7a-3p | 172 | 1193 | Embryonic stem cells, lung | inflammatory, various cancers (lung, cervical, breast, pancreatic, etc) | tumor suppressor, |
| hsa-let-7a-5p | 173 | 1194 | Embryonic stem cells, lung | inflammatory, various cancers (lung, cervical, breast, pancreatic, etc) | tumor suppressor, |
| hsa-let-7b-3p | 174 | 1195 | epithelial cells, endothelial cells (vascular) | lung cancer, colorectal cancer, cervical cancer, inflammation and immune response after infection | tumor angiogenesis |
| hsa-let-7b-5p | 175 | 1196 | epithelial cells, endothelial cells (vascular) | cervical cancer, inflammation and immune response after infection | tumor angiogenesis |
| hsa-let-7c | 176 | 1197 | dendritic cells | various cacners (cervical, pancreatic, lung, esopphageal, etc) | tumor suppressor, apoptosis |
| hsa-let-7d-3p | 177 | 1198 | embryonic stem cells | associated with various cancer cells | tumor suppressor |
| hsa-let-7d-5p | 178 | 1199 | embryonic stem cells | associated with various cancer cells | tumor suppressor |
| hsa-let-7e-3p | 179 | 1200 | immune cells | various cancer cells, autoimmunity, endotoxin tolerance | tumor suppressor |
| hsa-let-7e-5p | 180 | 1201 | immune cells | various cancer cells | tumor suppressor |
| hsa-let-7f-1-3p | 181 | 1202 | immune cells (T cells) | various cancer cells | tumor suppressor |
| hsa-let-7f-2-3p | 182 | 1203 | immune cells (T cells) | various cancer cells | tumor suppressor |
| hsa-let-7f-5p | 183 | 1204 | immune cells (T cells) | Various cancer cells | tumor suppressor |
| hsa-let-7g-3p | 184 | 1205 | hematopoietic cells, adipose, smooth muscle cells | various cancer cells (lung, breast, etc) | tumor suppressor |
| hsa-let-7g-5p | 185 | 1206 | hematopoietic cells, adipose, smooth muscle cells | various cancer cells (lung, breast, etc) | tumor suppressor |
| hsa-let-7i-3p | 186 | 1207 | immune cells | chronic lymphocyte leukimia | tumor suppressor |
| hsa-let-7i-5p | 187 | 1208 | immune cells | chronic lymphocyte leukimia | tumor suppressor |
| hsa-miR-1 | 188 | 1209 | muscle, heart | | angiogenesis, cell proliferation(myogenesis) |
| hsa-miR-100-3p | 189 | 1210 | hematopoietic cells, endothelial cells | gastric cancer, pancreatic cancer | tumor angiogenesis |
| hsa-miR-100-5p | 190 | 1211 | hematopoietic cells, endothelial cells | gastric cancer, pancreatic cancer | tumor angiogenesis |
| hsa-miR-101-3p | 191 | 1212 | endothelial cells | various cancers (breast, non-small | angiogenesis |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-101-5p | 192 | 1213 | endothelial cells | cell lung, colon, gastric, pancreatic, bladder, etc); lupus erythematosus various cancers (breast, non-small cell lung, colon, gastric, pancreatic, bladder, etc); lupus erythematosus | angiogenesis |
| hsa-miR-103a-2-5p | 193 | 1214 | embryonic stem cells, many tissues/cells | various cancers (endometrial, neuroblastoma, colorectal, breast, liver, etc) | oncogene, cell growth |
| hsa-miR-103a-3p | 194 | 1215 | embryonic stem cells, many tissues/cells | various cancers (endometrial, neuroblastoma, colorectal, breast, liver, etc) | oncogene, cell growth |
| hsa-miR-103b | 195 | 1216 | Many tissues/cells | various cancers (endometrial, neuroblastoma, colorectal, breast, liver, etc) | oncogene, cell growth |
| hsa-miR-105-3p | 196 | 1217 | pancreatic cells | | |
| hsa-miR-105-5p | 197 | 1218 | pancreatic cells | | |
| hsa-miR-106a-3p | 198 | 1219 | osteogenic cells | osteocarcoma, other cancers | cell differentiation |
| hsa-miR-106a-5p | 199 | 1220 | osteogenic cells | osteocarcoma, other cancers | cell differentiation |
| hsa-miR-106b-3p | 200 | 1221 | embryonic stem cells | various cancers (non-small lung cancer, gastric cancer, HCC, gliomas, etc) | oncogene |
| hsa-miR-106b-5p | 201 | 1222 | embryonic stem cells | various cancers (non-small lung cancer, gastric cancer, HCC, gliomas, etc) | oncogene |
| hsa-miR-107 | 202 | 1223 | many tissues, brain hepatocytes/liver | breast cancer, pituitary adenoma, obesity/diabetes | |
| hsa-miR-10a-3p | 203 | 1224 | hematopoeitic cells | acute myeoid leukemia | oncogene, cell growth |
| hsa-miR-10a-5p | 204 | 1225 | hematopoeitic cells | acute myeoid leukemia | oncogene, cell growth |
| hsa-miR-10b-3p | 205 | 1226 | multiple tissues and cells | various cancers (breast, ovarian, glioblastoma, pancreatc ductal adenocarcinoma, gastric, etc) | oncogene |
| hsa-miR-10b-5p | 206 | 1227 | multiple tissues and cells | various cancers (breast, ovarian, glioblastoma, pancreatc ductal adenocarcinoma, gastric, etc) | oncogene |
| hsa-miR-1178-3p | 207 | 1228 | | osteocarcoma | |
| hsa-miR-1178-5p | 208 | 1229 | | osteocarcoma | |
| hsa-miR-1179 | 209 | 1230 | | osteocarcoma | |
| hsa-miR-1180 | 210 | 1231 | discovered in sarcoma, no expression data | | |
| hsa-miR-1181 | 211 | 1232 | | downregulated in ovarian cancer cells, associated with | |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | | HCV infection in hepatocytes | |
| hsa-miR-1182 | 212 | 1233 | placenta | | |
| hsa-miR-1183 | 213 | 1234 | | associated with rectal cancer | |
| hsa-miR-1184 | 214 | 1235 | Hematopoietic cells | downregulated in oral leukoplakia (OLK) | |
| hsa-miR-1185-1-3p | 215 | 1236 | placenta | | |
| hsa-miR-1185-2-3p | 216 | 1237 | placenta | | |
| hsa-miR-1185-5p | 217 | 1238 | placenta | | |
| hsa-miR-1193 | 218 | 1239 | | melanoma | |
| hsa-miR-1197 | 219 | 1240 | | neublastoma | |
| hsa-miR-1200 | 220 | 1241 | | chronic lynphocytic leukemia | |
| hsa-miR-1202 | 221 | 1242 | | chronic lynphocytic leukemia, downregulated in ovarian cancer cells | |
| hsa-miR-1203 | 222 | 1243 | | in the chromosome 8q24 region, cancer cells | |
| hsa-miR-1204 | 223 | 1244 | | in the chromosome 8q24 region, cancer cells | |
| hsa-miR-1205 | 224 | 1245 | | in the chromosome 8q24 region, cancer cells | |
| hsa-miR-1206 | 225 | 1246 | | in the chromosome 8q24 region, cancer cells | |
| hsa-miR-1207-3p | 226 | 1247 | | in the chromosome 8q24 region, cancer cells | |
| hsa-miR-1207-5p | 227 | 1248 | | in the chromosome 8q24 region, cancer cells | |
| hsa-miR-1208 | 228 | 1249 | | in the chromosome 8q24 region, cancer cells | |
| hsa-miR-122-3p | 229 | 1250 | kidney, liver/hepatocytes | Renal Cell Carcinoma (RCC), cancer cells | lipid metabolism |
| hsa-miR-1224-3p | 230 | 1251 | | Lupus nephritis | |
| hsa-miR-1224-5p | 231 | 1252 | | rectal cancer | |
| hsa-miR-1225-3p | 232 | 1253 | | adrenal pheochromocytomas; upregulated in MITF KnockDown melanocytes | |
| hsa-miR-1225-5p | 233 | 1254 | | prostate cancer | |
| hsa-miR-122-5p | 234 | 1255 | liver/hepatocytes | cancer cells | lipid metabolism |
| hsa-miR-1226-3p | 235 | 1256 | discovered in a mirtron screening | | |
| hsa-miR-1226-5p | 236 | 1257 | discovered in a mirtron screening | | |
| hsa-miR-1227-3p | 237 | 1258 | cartilage/chondrocytes | | |
| hsa-miR-1227-5p | 238 | 1259 | cartilage/chondrocytes | | |
| hsa-miR-1228-3p | 239 | 1260 | liver(hepatocytes) | Hepatocellular carcinoma(HCC) | anti-apoptosis |
| hsa-miR-1228-5p | 240 | 1261 | liver(hepatocytes) | Hepatocellular carcinoma(HCC) | anti-apoptosis |
| hsa-miR-1229-3p | 241 | 1262 | discovered in a mirtron screening | | |
| hsa-miR-1229-5p | 242 | 1263 | discovered in a mirtron screening | | |
| hsa-miR-1231 | 243 | 1264 | | HCC | |
| hsa-miR-1233-1-5p | 244 | 1265 | serum | | |
| hsa-miR-1233-3p | 245 | 1266 | serum | | |
| hsa-miR-1234-3p | 246 | 1267 | discovered in | | |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | embryonic stem cell | | |
| hsa-miR-1234-5p | 247 | 1268 | discovered in embryonic stem cell | | |
| hsa-miR-1236-3p | 248 | 1269 | lymphatic endothelial cells | | target to VEGFR-3 |
| hsa-miR-1236-5p | 249 | 1270 | lymphatic endothelial cells | | target to VEGFR-3 |
| hsa-miR-1237-3p | 250 | 1271 | esophageal cell line KYSE-150R | | |
| hsa-miR-1237-5p | 251 | 1272 | esophageal cell line KYSE-150R | | |
| hsa-miR-1238-3p | 252 | 1273 | | colorectal cancer | |
| hsa-miR-1238-5p | 253 | 1274 | | colorectal cancer | |
| hsa-miR-1243 | 254 | 1275 | discovered in embryonic stem cells | | |
| hsa-miR-124-3p | 255 | 1276 | brain, plasma (exosomal) | glioma | cell differentiation |
| hsa-miR-1244 | 256 | 1277 | discovered in embryonic stem cells | | |
| hsa-miR-1245a | 257 | 1278 | discovered in embryonic stem cells | | |
| hsa-miR-1245b-3p | 258 | 1279 | discovered in embryonic stem cells | | |
| hsa-miR-1245b-5p | 259 | 1280 | discovered in embryonic stem cells | | |
| hsa-miR-124-5p | 260 | 1281 | brain, Plasma (circulating) | upregulated in heart dysfunction, glioma | cell differentiation |
| hsa-miR-1246 | 261 | 1282 | embryonic stem cells, epithelial cells | | |
| hsa-miR-1247-3p | 262 | 1283 | embryoid body cells | | |
| hsa-miR-1247-5p | 263 | 1284 | embryoid body cells | | |
| hsa-miR-1248 | 264 | 1285 | | | component of SnoRNAs |
| hsa-miR-1249 | 265 | 1286 | liver(hepatocytes) | | |
| hsa-miR-1250 | 266 | 1287 | oligodendrocytes | | |
| hsa-miR-1251 | 267 | 1288 | discovered in embryonic stem cells | | |
| hsa-miR-1252 | 268 | 1289 | discovered in embryonic stem cells | | |
| hsa-miR-1253 | 269 | 1290 | discovered in embryonic stem cells | | |
| hsa-miR-1254 | 270 | 1291 | embryonic stem cells | | |
| hsa-miR-1255a | 271 | 1292 | discovered in embryonic stem cells | | |
| hsa-miR-1255b-2-3p | 272 | 1293 | discovered in embryonic stem cells | | |
| hsa-miR-1255b-5p | 273 | 1294 | discovered in embryonic stem cells | | |
| hsa-miR-1256 | 274 | 1295 | discovered in embryonic stem cells | prostate cancer | |
| hsa-miR-1257 | 275 | 1296 | discovered in embryonic stem cells | liposarcoma (soft tissue sarcoma) | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-1258 | 276 | 1297 | discovered in embryonic stem cells | breast cancer and lung cancer | |
| hsa-miR-125a-3p | 277 | 1298 | brain, hematopoietic cells | various cancer (prostate, HCC, etc) | cell proliferation and differentiation |
| hsa-miR-125a-5p | 278 | 1299 | brain, hematopoietic cells | various cancer (prostate, HCC, etc) | cell proliferation and differentiation |
| hsa-miR-125b-1-3p | 279 | 1300 | hematopoietic cells (monocytes), brain(neuron) | various cancer (prostate, HCC, etc) | oncogene, cell differentiation |
| hsa-miR-125b-2-3p | 280 | 1301 | hematopoietic cells (monocytes), brain(neuron) | various cancer (prostate, HCC, etc) | oncogene, cell differentiation |
| hsa-miR-125b-5p | 281 | 1302 | hematopoietic cells, brain (neuron) | various cancer (cutaneous T cell lymphoma, prostate, HCC, etc) | oncogene, cell differentiation |
| hsa-miR-1260a | 282 | 1303 | periodontal tissue | | |
| hsa-miR-1260b | 283 | 1304 | periodontal tissue | | |
| hsa-miR-1261 | 284 | 1305 | embryonic stem cells | | |
| hsa-miR-1262 | 285 | 1306 | embryoid body cells | | |
| hsa-miR-1263 | 286 | 1307 | discovered in embryonic stem cells | | |
| hsa-miR-126-3p | 287 | 1308 | endothelial cells, lung | B-lieage ALL | angiogenesis |
| hsa-miR-1264 | 288 | 1309 | discovered in embryonic stem cells | | |
| hsa-miR-1265 | 289 | 1310 | discovered in embryonic stem cells | | |
| hsa-miR-126-5p | 290 | 1311 | endothelial cells, lung | breast cancer, B-lieage ALL | angiogenesis |
| hsa-miR-1266 | 291 | 1312 | embryonic stem cells | | |
| hsa-miR-1267 | 292 | 1313 | discovered in embryonic stem cells | | |
| hsa-miR-1268a | 293 | 1314 | embryonic stem cells | | |
| hsa-miR-1268b | 294 | 1315 | embryonic stem cells | | |
| hsa-miR-1269a | 295 | 1316 | embryoid body cells | | |
| hsa-miR-1269b | 296 | 1317 | embryoid body cells | | |
| hsa-miR-1270 | 297 | 1318 | discovered in embryonic stem cells | | |
| hsa-miR-1271-3p | 298 | 1319 | brain | Hepatocellular carcinoma(HCC) | Suppress GPC-3 in HCC |
| hsa-miR-1271-5p | 299 | 1320 | brain | Hepatocellular carcinoma(HCC) | Suppress GPC-3 in HCC |
| hsa-miR-1272 | 300 | 1321 | embryonic stem cells | | |
| hsa-miR-1273a | 301 | 1322 | discovered in embryonic stem cells | | |
| hsa-miR-1273c | 302 | 1323 | | colorectal cancer | |
| hsa-miR-1273d | 303 | 1324 | discovered in embryonic stem cells | | |
| hsa-miR-1273e | 304 | 1325 | | solid tumor cells | |
| hsa-miR-1273f | 305 | 1326 | | cervical cancer | |
| hsa-miR-1273g-3p | 306 | 1327 | | cervical cancer | |
| hsa-miR-1273g-5p | 307 | 1328 | | cervical cancer | |
| hsa-miR-127-3p | 308 | 1329 | lung, placenta | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-1275 | 309 | 1330 | embryonic stem cells | gastric carcinoma | |
| hsa-miR-127-5p | 310 | 1331 | lung, placenta(islet) | | |
| hsa-miR-1276 | 311 | 1332 | discovered in embryonic stem cells | | |
| hsa-miR-1277-3p | 312 | 1333 | embryoid body cells | | |
| hsa-miR-1277-5p | 313 | 1334 | embryoid body cells | | |
| hsa-miR-1278 | 314 | 1335 | discovered in embryonic stem cells | | |
| hsa-miR-1279 | 315 | 1336 | monocytes | | |
| hsa-miR-128 | 316 | 1337 | glioblast, brain | B-lieage ALL | target to neurofibrominlin neuron |
| hsa-miR-1281 | 317 | 1338 | | muscle invasive bladder cancer | |
| hsa-miR-1282 | 318 | 1339 | discovered in embryonic stem cells | | |
| hsa-miR-1283 | 319 | 1340 | placenta | | |
| hsa-miR-1284 | 320 | 1341 | | lung cancer | |
| hsa-miR-1285-3p | 321 | 1342 | | various cancer cells | inhibit P53 expression |
| hsa-miR-1285-5p | 322 | 1343 | | various cancer cells | inhibit P53 expression |
| hsa-miR-1286 | 323 | 1344 | smooth muscle | esophageal cancer | |
| hsa-miR-1287 | 324 | 1345 | embryoid body cells | breast cancer | |
| hsa-miR-1288 | 325 | 1346 | discovered in embryonic stem cells | | |
| hsa-miR-1289 | 326 | 1347 | multiple cell types | | |
| hsa-miR-1290 | 327 | 1348 | embryoid body cells | gastric carcinoma | |
| hsa-miR-1291 | 328 | 1349 | hepatocytes | | component of SnoRNAs |
| hsa-miR-129-1-3p | 329 | 1350 | multiple cell types | HCC cancer cells | |
| hsa-miR-1292-3p | 330 | 1351 | | | |
| hsa-miR-129-2-3p | 331 | 1352 | multiple cell types | various cancer cells | |
| hsa-miR-1292-5p | 332 | 1353 | | | |
| hsa-miR-1293 | 333 | 1354 | discovered in embryonic stem cells | | |
| hsa-miR-1294 | 334 | 1355 | discovered in embryonic stem cells | | |
| hsa-miR-1295a | 335 | 1356 | | tumor cells (follicular lymphoma) | |
| hsa-miR-1295b-3p | 336 | 1357 | | tumor cells (follicular lymphoma) | |
| hsa-miR-1295b-5p | 337 | 1358 | | tumor cells (follicular lymphoma) | |
| hsa-miR-129-5p | 338 | 1359 | liver(hepatocytes) | HCC, thyroid cancer | cell death in cancer cell |
| hsa-miR-1296 | 339 | 1360 | | breast cancer | |
| hsa-miR-1297 | 340 | 1361 | discovered in embryonic stem cells | | |
| hsa-miR-1298 | 341 | 1362 | | | |
| hsa-miR-1299 | 342 | 1363 | discovered in embryonic stem cells | | |
| hsa-miR-1301 | 343 | 1364 | | breast cancer | |
| hsa-miR-1302 | 344 | 1365 | | | |
| hsa-miR-1303 | 345 | 1366 | hepatocyte | colorectal cancer, liver cancer | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-1304-3p | 346 | 1367 | | | dental development |
| hsa-miR-1304-5p | 347 | 1368 | | | dental development |
| hsa-miR-1305 | 348 | 1369 | discovered in embryonic stem cells | | |
| hsa-miR-1306-3p | 349 | 1370 | discovered in embryonic stem cells | | |
| hsa-miR-1306-5p | 350 | 1371 | discovered in embryonic stem cells | | |
| hsa-miR-1307-3p | 351 | 1372 | discovered in embryonic stem cells | | |
| hsa-miR-1307-5p | 352 | 1373 | discovered in embryonic stem cells | | |
| hsa-miR-130a-3p | 353 | 1374 | lung, monocytes, vascular endothelial cells | various cancers (basal cell carcinoma, HCC, ovarian, etc), drug resistance | pro-angiogenic |
| hsa-miR-130a-5p | 354 | 1375 | lung, monocytes, vascular endothelial cells | various cancers (basal cell carcinoma, HCC, ovarian, etc), drug resistance | pro-angiogenic |
| hsa-miR-130b-3p | 355 | 1376 | Lung, epidermal cells (keratinocytes) | various cancers (gastric, rena cell carcinoma) | cell proiferation/senescence |
| hsa-miR-130b-5p | 356 | 1377 | Lung, epidermal cells (keratinocytes) | various cancers (gastric, rena cell carcinoma) | cell proiferation/senescence |
| hsa-miR-1321 | 357 | 1378 | | neuroblastoma | |
| hsa-miR-1322 | 358 | 1379 | | neuroblastoma | |
| hsa-miR-1323 | 359 | 1380 | placenta | neuroblastoma | |
| hsa-miR-132-3p | 360 | 1381 | Brain(neuron), immune cells | | |
| hsa-miR-1324 | 361 | 1382 | | neuroblastoma | |
| hsa-miR-132-5p | 362 | 1383 | brain(neuron), immune cells | | |
| hsa-miR-133a | 363 | 1384 | muscle, heart, epithelial cells (lung) | heart failure, esophageal cancer | myogenesis |
| hsa-miR-133b | 364 | 1385 | muscle, heart, epithelial cells (lung) | heart failure, esophageal cancer | myogenesis |
| hsa-miR-134 | 365 | 1386 | lung (epithelial) | non-samll cell lung cancer, pulmonary embolism | |
| hsa-miR-1343 | 366 | 1387 | | breast cancer cells | |
| hsa-miR-135a-3p | 367 | 1388 | brain, other tissues | various cancer cells (lung, breast, colorectal, HCC, etc) | tumor suppressor |
| hsa-miR-135a-5p | 368 | 1389 | brain, other tissues | various cancer cells (lung, breast, colorectal, HCC, etc) | tumor suppressor |
| hsa-miR-135b-3p | 369 | 1390 | brain, placenta, other tissues | various cancers (gastric, mammary, neuroblastomas, pancreatic, etc) | |
| hsa-miR-135b-5p | 370 | 1391 | brain, placenta, other tissues | various cancers (gastric, mammary, neuroblastomas, pancreatic, etc) | |
| hsa-miR-136-3p | 371 | 1392 | stem cells, placenta | glioma | tumor suppressor |
| hsa-miR-136-5p | 372 | 1393 | stem cells, placenta | glioma | tumor suppressor |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-137 | 373 | 1394 | brain | various cancers (glioblastoma, breast, gastric etc), Alzheimer's disease | inhibiting cancer cell proliferation and migration |
| hsa-miR-138-1-3p | 374 | 1395 | stem cells, epidermal cells(keratinocytes) | arious cancer cells, downregulated in HCC | cell proliferation/senescence |
| hsa-miR-138-2-3p | 375 | 1396 | stem cells | arious cancer cells, downregulated in HCC | |
| hsa-miR-138-5p | 376 | 1397 | stem cells | arious cancer cells, downregulated in HCC | |
| hsa-miR-139-3p | 377 | 1398 | hematocytes, brain | various cancer cells (colorectal, gastric, ovarian) | repress cancer metastasis |
| hsa-miR-139-5p | 378 | 1399 | hematocytes, brain | various cancer cells (colorectal, gastric, ovarian) | repress cancer metastasis |
| hsa-miR-140-3p | 379 | 1400 | airway smooth muscle | Virus infection, cancers | |
| hsa-miR-140-5p | 380 | 1401 | cartilage (chondrocytes) | csncers | |
| hsa-miR-141-3p | 381 | 1402 | Many tissues/cells | various cancer cells (HCC, prostate, kidney, etc) | cell differentiation |
| hsa-miR-141-5p | 382 | 1403 | Many tissues/cells | various cancer cells (HCC, prostate, kidney, etc) | cell differentiation |
| hsa-miR-142-3p | 383 | 1404 | meyloid cells, hematopoiesis, APC cells | | immune response |
| hsa-miR-142-5p | 384 | 1405 | meyloid cells, hematopoiesis, APC cells | | immune response |
| hsa-miR-143-3p | 385 | 1406 | vascular smooth muscle | pre-B-cell acute lymphocytic leukemia, virus infection | |
| hsa-miR-143-5p | 386 | 1407 | vascular smooth muscle, T-cells | virus infection | |
| hsa-miR-144-3p | 387 | 1408 | erythroid | various cancers (lung, colorectal, etc) | cell differentiation |
| hsa-miR-144-5p | 388 | 1409 | erythroid | various cancers (lung, colorectal, etc) | cell differentiation |
| hsa-miR-145-3p | 389 | 1410 | kidney, cartilage, vascular smooth muscle | T-cell lupus | tumor suppressor |
| hsa-miR-145-5p | 390 | 1411 | kidney, cartilage, vascular smooth muscle | T-cell lupus | tumor suppressor |
| hsa-miR-1468 | 391 | 1412 | | lung cancer | |
| hsa-miR-1469 | 392 | 1413 | | tumor cell(follicular lymphoma), rectal cancer | |
| hsa-miR-146a-3p | 393 | 1414 | immune cells, hematopoiesis | various cancers, endotoxin tolerance | |
| hsa-miR-146a-5p | 394 | 1415 | immune cells, hematopoiesis | various cancers, endotoxin tolerance | |
| hsa-miR-146b-3p | 395 | 1416 | immune cells | various cancers | |
| hsa-miR-146b-5p | 396 | 1417 | Embryonic stem cells | various cancers (glioma) | tumor invation, migration |
| hsa-miR-1470 | 397 | 1418 | | | |
| hsa-miR-1471 | 398 | 1419 | | tumor cell(follicular | |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | | lymphoma), rectal cancer | |
| hsa-miR-147a | 399 | 1420 | Macrophage | inflammatory response | |
| hsa-miR-147b | 400 | 1421 | Macrophage | inflammatory response | |
| hsa-miR-148a-3p | 401 | 1422 | hematopoietic cells | CLL, T-lineage ALL | |
| hsa-miR-148a-5p | 402 | 1423 | hematopoietic cells | CLL, T-lineage ALL | |
| hsa-miR-148b-3p | 403 | 1424 | neuron | | |
| hsa-miR-148b-5p | 404 | 1425 | neuron | | |
| hsa-miR-149-3p | 405 | 1426 | heart, brain | various cancers (glioma, colorectal, gastric, etc) | |
| hsa-miR-149-5p | 406 | 1427 | heart, brain | various cancers (glioma, colorectal, gastric, etc) | |
| hsa-miR-150-3p | 407 | 1428 | hematopoietic cells (lymphoid) | circulating plasma (acute myeloid leukemia) | |
| hsa-miR-150-5p | 408 | 1429 | hematopoietic cells (lymphoid) | circulating plasma (acute myeloid leukemia) | |
| hsa-miR-151a-3p | 409 | 1430 | neuron, fetal liver | | |
| hsa-miR-151a-5p | 410 | 1431 | neuron, fetal liver | | |
| hsa-miR-151b | 411 | 1432 | immune cells (B-cells) | | |
| hsa-miR-152 | 412 | 1433 | liver | | |
| hsa-miR-153 | 413 | 1434 | brain | | |
| hsa-miR-1537 | 414 | 1435 | | | |
| hsa-miR-1538 | 415 | 1436 | blood | Cancer cells | |
| hsa-miR-1539 | 416 | 1437 | esophageal cell line KYSE-150R | | |
| hsa-miR-154-3p | 417 | 1438 | embryonic stem cells | | |
| hsa-miR-154-5p | 418 | 1439 | embryonic stem cells | | |
| hsa-miR-155-3p | 419 | 1440 | T/B cells, monocytes, breast | various cancers (CLL, B cell lymphoma, breast, lung, ovarian, cervical, colorectal, prostate) | |
| hsa-miR-155-5p | 420 | 1441 | T/B cells, monocytes, breast | various cancers (CLL, B cell lymphoma, breast, lung, ovarian, cervical, colorectal, prostate) | |
| hsa-miR-1587 | 421 | 1442 | identified in B-cells | | |
| hsa-miR-15a-3p | 422 | 1443 | blood, lymphocyte, hematopoietic tissues (spleen) | | cell cycle, proliferation |
| hsa-miR-15a-5p | 423 | 1444 | blood, lymphocyte, hematopoietic tissues (spleen) | | cell cycle, proliferation |
| hsa-miR-15b-3p | 424 | 1445 | blood, lymphocyte, hematopoietic tissues (spleen) | | cell cycle, proliferation |
| hsa-miR-15b-5p | 425 | 1446 | blood, lymphocyte, hematopoietic tissues (spleen) | | cell cycle, proliferation |
| hsa-miR-16-1-3p | 426 | 1447 | embryonic stem cells, blood, | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-16-2-3p | 427 | 1448 | hematopoietic tissues (spleen) blood, lymphocyte, hematopoietic tissues (spleen) | | |
| hsa-miR-16-5p | 428 | 1449 | Many tissues, blood | | |
| hsa-miR-17-3p | 429 | 1450 | embryonic stem cells, endothelial cells, | | tumor angiogenesis |
| hsa-miR-17-5p | 430 | 1451 | endothelial cells, kidney, breast; | | tumor angiogenesis |
| hsa-miR-181a-2-3p | 431 | 1452 | glioblast, stem cells | | |
| hsa-miR-181a-3p | 432 | 1453 | glioblast, myeloid cells, Embryonic stem cells | | |
| hsa-miR-181a-5p | 433 | 1454 | glioblast, myeloid cells, Embryonic stem cells | | |
| hsa-miR-181b-3p | 434 | 1455 | glioblast, Embryonic stem cells, epidermal (keratinocytes) | | cell proliferation/senescence |
| hsa-miR-181b-5p | 435 | 1456 | glioblast, Embryonic stem cells, epidermal (keratinocytes) | | cell proliferation/senescence |
| hsa-miR-181c-3p | 436 | 1457 | brain, stem cells/progenitor | variou cance cells (gliobasltoma, basal cell carcinoma, prostate) | cell differentiation |
| hsa-miR-181c-5p | 437 | 1458 | brain, stem cells/progenitor | variou cance cells (gliobasltoma, basal cell carcinoma, prostate) | cell differentiation |
| hsa-miR-181d | 438 | 1459 | glia cells | | |
| hsa-miR-182-3p | 439 | 1460 | immune cells | autoimmune | immune response |
| hsa-miR-1825 | 440 | 1461 | discovered in a MiRDeep screening | | |
| hsa-miR-182-5p | 441 | 1462 | lung, immune cells | autoimmune | immune response |
| hsa-miR-1827 | 442 | 1463 | | small cell lung cancer | |
| hsa-miR-183-3p | 443 | 1464 | brain | | |
| hsa-miR-183-5p | 444 | 1465 | brain | | |
| hsa-miR-184 | 445 | 1466 | blood, tongue, pancreas (islet) | | |
| hsa-miR-185-3p | 446 | 1467 | | | |
| hsa-miR-185-5p | 447 | 1468 | | | |
| hsa-miR-186-3p | 448 | 1469 | osteoblasts, heart | various cancer cells | |
| hsa-miR-186-5p | 449 | 1470 | osteoblasts, heart | various cancer cells | |
| hsa-miR-187-3p | 450 | 1471 | | thyroid tumor | |
| hsa-miR-187-5p | 451 | 1472 | | thyroid tumor | |
| hsa-miR-188-3p | 452 | 1473 | irway smooth muscle, central nervous system | | |
| hsa-miR-188-5p | 453 | 1474 | irway smooth muscle, central nervous system | | |
| hsa-miR-18a-3p | 454 | 1475 | endothelial cells, lung | | |
| hsa-miR-18a-5p | 455 | 1476 | endothelial cells, lung | | |
| hsa-miR-18b-3p | 456 | 1477 | lung | | |
| hsa-miR-18b-5p | 457 | 1478 | lung | | |
| hsa-miR-1908 | 458 | 1479 | | breast cancer | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-1909-3p | 459 | 1480 | | rectal cancer | |
| hsa-miR-1909-5p | 460 | 1481 | | rectal cancer | |
| hsa-miR-190a | 461 | 1482 | brain | | |
| hsa-miR-190b | 462 | 1483 | brain | | |
| hsa-miR-1910 | 463 | 1484 | embryonic stem cells | | |
| hsa-miR-1911-3p | 464 | 1485 | embryonic stem cells, neural precursor | | |
| hsa-miR-1911-5p | 465 | 1486 | embryonic stem cells, neural precursor | | |
| hsa-miR-1912 | 466 | 1487 | embryonic stem cells, neural precursor | | |
| hsa-miR-1913 | 467 | 1488 | embryonic stem cells | | |
| hsa-miR-191-3p | 468 | 1489 | | chroninc lymphocyte leukimia, B-lieage ALL | |
| hsa-miR-1914-3p | 469 | 1490 | embryonic stem cells | | |
| hsa-miR-1914-5p | 470 | 1491 | embryonic stem cells | | |
| hsa-miR-1915-3p | 471 | 1492 | embryonic stem cells | | |
| hsa-miR-1915-5p | 472 | 1493 | embryonic stem cells | | |
| hsa-miR-191-5p | 473 | 1494 | | chroninc lymphocyte leukimia, B-lieage ALL | |
| hsa-miR-192-3p | 474 | 1495 | kidney | | |
| hsa-miR-192-5p | 475 | 1496 | kidney | | |
| hsa-miR-193a-3p | 476 | 1497 | many tissues/cells | various cancer cells (lung, osteoblastoma, ALL, follicular lymphoma, etc) | tumor suppressor, proliferation |
| hsa-miR-193a-5p | 477 | 1498 | many tissues/cells | various cancer cells (lung, osteoblastoma, ALL, follicular lymphoma, etc) | tumor suppressor, proliferation |
| hsa-miR-193b-3p | 478 | 1499 | many tissues/cells, semen | arious cancer cells (prostate, breast, melanoma, myeloma, non small cell lung, etc)follicular lymphoma) | tumor suppressor |
| hsa-miR-193b-5p | 479 | 1500 | many tissues/cells, semen | arious cancer cells (prostate, breast, melanoma, myeloma, non small cell lung, etc)follicular lymphoma) | tumor suppressor |
| hsa-miR-194-3p | 480 | 1501 | kidney, liver | various cancers | |
| hsa-miR-194-5p | 481 | 1502 | kidney, liver | various cancers | |
| hsa-miR-195-3p | 482 | 1503 | breast, pancreas (islet) | | |
| hsa-miR-195-5p | 483 | 1504 | breast, pancreas (islet) | | |
| hsa-miR-196a-3p | 484 | 1505 | pancreatic cells, endometrial tissues, mesenchymal stem cells | various cancer cells (pancreatic, osteosarcoma, endometrial, AML etc) | oncogenic, tumor suppressor |
| hsa-miR-196a-5p | 485 | 1506 | pancreatic cells, endometrial tissues, | various cancer cells (pancreatic, osteosarcoma, | oncogenic, tumor suppressor |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | mesenchymal stem cells | endometrial, AML etc) | |
| hsa-miR-196b-3p | 486 | 1507 | endometrial tissues | glioblastoma | apoptosis |
| hsa-miR-196b-5p | 487 | 1508 | endometrial tissues | glioblastoma | apoptosis |
| hsa-miR-1972 | 488 | 1509 | | acute lymphoblastic leukemia | |
| hsa-miR-1973 | 489 | 1510 | | acute lymphoblastic leukemia | |
| hsa-miR-197-3p | 490 | 1511 | blood (myeloid), other tissues/cells | various cancers (thyroid tumor, leukemia, etc) | |
| hsa-miR-197-5p | 491 | 1512 | blood (myeloid), other tissues/cells | various cancers (thyroid tumor, leukemia, etc) | |
| hsa-miR-1976 | 492 | 1513 | | acute lymphoblastic leukemia | |
| hsa-miR-198 | 493 | 1514 | central nevous system(CNS) | | |
| hsa-miR-199a-3p | 494 | 1515 | liver, embryoid body cells, cardiomyocytes | | |
| hsa-miR-199a-5p | 495 | 1516 | liver, cardiomyocytes | | |
| hsa-miR-199b-3p | 496 | 1517 | liver, osteoblast | various cancers | osteogenesis |
| hsa-miR-199b-5p | 497 | 1518 | liver, osteoblast | various cancers | osteogenesis |
| hsa-miR-19a-3p | 498 | 1519 | endothelial cells | | tumor angiogenesis |
| hsa-miR-19a-5p | 499 | 1520 | endothelial cells | | tumor angiogenesis |
| hsa-miR-19b-1-5p | 500 | 1521 | endothelial cells | | tumor angiogenesis |
| hsa-miR-19b-2-5p | 501 | 1522 | endothelial cells | | tumor angiogenesis |
| hsa-miR-19b-3p | 502 | 1523 | endothelial cells | | tumor angiogenesis |
| hsa-miR-200a-3p | 503 | 1524 | epithelial cells, many other tissues | various cancers (breast, cervical, bladder, etc) | tumor progression and metastasis |
| hsa-miR-200a-5p | 504 | 1525 | epithelial cells, many other tissues | various cancers (breast, cervical, bladder, etc) | tumor progression and metastasis |
| hsa-miR-200b-3p | 505 | 1526 | epithelial cells, many other tissues | | tumor progression and metastasis |
| hsa-miR-200b-5p | 506 | 1527 | epithelial cells, many other tissues | | tumor progression and metastasis |
| hsa-miR-200c-3p | 507 | 1528 | epithelial cells, many other tissues, embryonic stem cells | | tumor progression and metastasis |
| hsa-miR-200c-5p | 508 | 1529 | epithelial cells, many other tissues, embryonic stem cells | | tumor progression and metastasis |
| hsa-miR-202-3p | 509 | 1530 | blood | lymphomagenesis, other cancers | |
| hsa-miR-202-5p | 510 | 1531 | blood | lymphomagenesis, other cancers | |
| hsa-miR-203a | 511 | 1532 | skin (epithelium) | psoriasis, autoimmune | |
| hsa-miR-203b-3p | 512 | 1533 | skin specific (epithelium) | psoriasis, autoimmune | |
| hsa-miR-203b-5p | 513 | 1534 | skin specific (epithelium) | psoriasis, autoimmune | |
| hsa-miR-204-3p | 514 | 1535 | adipose, other tissues/cells. kidney | various cancers | tumor metastasis |
| hsa-miR-204-5p | 515 | 1536 | adipose, other tissues/cells, kidney | various cancers | tumor metastasis |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-2052 | 516 | 1537 | | | |
| hsa-miR-2053 | 517 | 1538 | | | |
| hsa-miR-205-3p | 518 | 1539 | blood(plasma) | various cancer cells (breast, glioma, melanoma, endometrial, etc) | |
| hsa-miR-2054 | 519 | 1540 | | | |
| hsa-miR-205-5p | 520 | 1541 | blood(plasma) | various cancer cells (breast, glioma, melanoma, endometrial, etc) | |
| hsa-miR-206 | 521 | 1542 | muscle (cardiac and skeletal) | | myogenesis |
| hsa-miR-208a | 522 | 1543 | heart(cardiomyocyte), muscle | cardiac defects | |
| hsa-miR-208b | 523 | 1544 | heart(cardiomyocyte), muscle | cardiac defects | |
| hsa-miR-20a-3p | 524 | 1545 | endothelial cells, kidney, osteogenic cells | | |
| hsa-miR-20a-5p | 525 | 1546 | endothelial cells, kidney, osteogenic cells | | |
| hsa-miR-20b-3p | 526 | 1547 | osteogenic cells | | |
| hsa-miR-20b-5p | 527 | 1548 | osteogenic cells | | |
| hsa-miR-210 | 528 | 1549 | kidney, heart, vascular endothelial cells | RCC, B-cell lymphocytes | angiogenesis |
| hsa-miR-2110 | 529 | 1550 | | rectal cancer | |
| hsa-miR-2113 | 530 | 1551 | embryonic stem cells | | |
| hsa-miR-211-3p | 531 | 1552 | melanocytes | melanoma and other cancers | |
| hsa-miR-2114-3p | 532 | 1553 | ovary, female reproductuve tract | | |
| hsa-miR-2114-5p | 533 | 1554 | ovary, female reproductuve tract | | |
| hsa-miR-2115-3p | 534 | 1555 | female reproductive tract | ovarian cancer | |
| hsa-miR-2115-5p | 535 | 1556 | female reproductive tract | ovarian cancer | |
| hsa-miR-211-5p | 536 | 1557 | melanocytes | melanoma and other cancers | |
| hsa-miR-2116-3p | 537 | 1558 | | live cancer(hepatocytes) and ovarian cancer | |
| hsa-miR-2116-5p | 538 | 1559 | | live cancer(hepatocytes) and ovarian cancer | |
| hsa-miR-2117 | 539 | 1560 | | ovarian cancer | |
| hsa-miR-212-3p | 540 | 1561 | brain(neuron), spleen | lymphoma | |
| hsa-miR-212-5p | 541 | 1562 | brain(neuron), spleen | lymphoma | |
| hsa-miR-21-3p | 542 | 1563 | glioblast, Blood (meyloid cells), liver, vascular endothelial cells | autoimmune, heart diseases, cancers | |
| hsa-miR-214-3p | 543 | 1564 | immune cerlls, pancreas | varioua cancers (melanoma, pancreatic, ovarian) | immune response |
| hsa-miR-214-5p | 544 | 1565 | immune cells, pancreas | varioua cancers (melanoma, pancreatic, ovarian) | immune response |
| hsa-miR-215 | 545 | 1566 | many tissues/cells | various cancers (renal, colon, osteosarcoma) | cell cycle arrest/p53 inducible |
| hsa-miR-21-5p | 546 | 1567 | blood (myeloid cells), liver, endothelial cells | autoimmune, heart diseases, cancers | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-216a-3p | 547 | 1568 | kidney, pancreas | | |
| hsa-miR-216a-5p | 548 | 1569 | kidney, pancreas | | |
| hsa-miR-216b | 549 | 1570 | | cancers | senescence |
| hsa-miR-217 | 550 | 1571 | endothelial cells | various cancer cells (pancreas, kidney, breast) | |
| hsa-miR-218-1-3p | 551 | 1572 | endothelial cells | various cancer cells (gastric tumor, bladder, cervical, etc) | |
| hsa-miR-218-2-3p | 552 | 1573 | | various cancer cells (gastric tumor, bladder, cervical, etc) | |
| hsa-miR-218-5p | 553 | 1574 | | various cancer cells (gastric tumor, bladder, cervical, etc) | |
| hsa-miR-219-1-3p | 554 | 1575 | brain, oligodendrocytes | | |
| hsa-miR-219-2-3p | 555 | 1576 | brain, oligodendrocytes | | |
| hsa-miR-219-5p | 556 | 1577 | brain, oligodendrocytes | | |
| hsa-miR-221-3p | 557 | 1578 | endothelial cells, immune cells | leukemia and other cancers | angiogenesis/vasculogenesis |
| hsa-miR-221-5p | 558 | 1579 | endothelial cells, immune cells | leukemia and other cancers | angiogenesis/vasculogenesis |
| hsa-miR-222-3p | 559 | 1580 | endothelial cells | various cancers | angiogenesis |
| hsa-miR-222-5p | 560 | 1581 | endothelial cells | various cancers | angiogenesis |
| hsa-miR-223-3p | 561 | 1582 | meyloid cells | leukemia | |
| hsa-miR-223-5p | 562 | 1583 | meyloid cells | leukemia | |
| hsa-miR-22-3p | 563 | 1584 | many tissues/cells | various cancers | tumorigenesis |
| hsa-miR-224-3p | 564 | 1585 | blood(plasma), ovary | cancers and inflammation | |
| hsa-miR-224-5p | 565 | 1586 | blood(plasma), ovary | cancers and inflammation | |
| hsa-miR-22-5p | 566 | 1587 | many tissues/cells | Various cancers | tumorigenesis |
| hsa-miR-2276 | 567 | 1588 | | breast cancer | |
| hsa-miR-2277-3p | 568 | 1589 | female reproductive tract | | |
| hsa-miR-2277-5p | 569 | 1590 | female reproductive tract | | |
| hsa-miR-2278 | 570 | 1591 | | breast cancer | |
| hsa-miR-2355-3p | 571 | 1592 | embryonic stem cells | | |
| hsa-miR-2355-5p | 572 | 1593 | embryonic stem cells | | |
| hsa-miR-2392 | 573 | 1594 | identified in B-cells | | |
| hsa-miR-23a-3p | 574 | 1595 | brain(astrocyte), endothelial cells, blood(erythroid) | Cancers | |
| hsa-miR-23a-5p | 575 | 1596 | brain(astrocyte), endothelial cells, blood(erythroid) | cancers | |
| hsa-miR-23b-3p | 576 | 1597 | blood, meyloid cells | cancers (renal cancer, glioblastoma, prostate, etc) and autoimmune | |
| hsa-miR-23b-5p | 577 | 1598 | blood, meyloid cells | cancers(glioblastoma, prostate, etc) and autoimmune | |
| hsa-miR-23c | 578 | 1599 | | cervical cancer | |
| hsa-miR-24-1-5p | 579 | 1600 | lung, meyloid cells | | |
| hsa-miR-24-2-5p | 580 | 1601 | lung, meyloid cells | | |
| hsa-miR-24-3p | 581 | 1602 | lung, meyloid cells | | |
| hsa-miR-2467-3p | 582 | 1603 | | breast cancer | |
| hsa-miR-2467-5p | 583 | 1604 | | breast cancer | |
| hsa-miR-25-3p | 584 | 1605 | embryonic stem cells, airway smooth muscle | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-25-5p | 585 | 1606 | embryonic stem cells, airway smooth muscle | | |
| hsa-miR-2681-3p | 586 | 1607 | | breast cancer | |
| hsa-miR-2681-5p | 587 | 1608 | | breast cancer | |
| hsa-miR-2682-3p | 588 | 1609 | | | |
| hsa-miR-2682-5p | 589 | 1610 | | | |
| hsa-miR-26a-1-3p | 590 | 1611 | embryonic stem cells, blood, other tissues | CLL and other cancers | cell cycle and differentiation |
| hsa-miR-26a-2-3p | 591 | 1612 | blood, other tissues | CLL and other cancers | cell cycle and differentiation |
| hsa-miR-26a-5p | 592 | 1613 | blood, other tissues | CLL and other cancers | cell cycle and differentiation |
| hsa-miR-26b-3p | 593 | 1614 | hematopoietic cells | | |
| hsa-miR-26b-5p | 594 | 1615 | hematopoietic cells | | |
| hsa-miR-27a-3p | 595 | 1616 | meyloid cells | various cancer cells | |
| hsa-miR-27a-5p | 596 | 1617 | meyloid cells | various cancer cells | |
| hsa-miR-27b-3p | 597 | 1618 | meyloid cells, vascular endothelial cells | various cancer cells | pro-angiogenic |
| hsa-miR-27b-5p | 598 | 1619 | meyloid cells, vascular endothelial cells | various cancer cells | pro-angiogenic |
| hsa-miR-28-3p | 599 | 1620 | blood(immune cells) | B/T cell lymphoma | |
| hsa-miR-28-5p | 600 | 1621 | blood(immune cells) | B/T cell lymphoma | |
| hsa-miR-2861 | 601 | 1622 | osteoblasts | basal cell carcinoma | |
| hsa-miR-2909 | 602 | 1623 | T-Lymphocytes | | |
| hsa-miR-296-3p | 603 | 1624 | kidney, heart, lung, entothelial cells | | angiogenesis |
| hsa-miR-2964a-3p | 604 | 1625 | | | |
| hsa-miR-2964a-5p | 605 | 1626 | | | |
| hsa-miR-296-5p | 606 | 1627 | lung, liver, endothelial cells | | angiogenesis |
| hsa-miR-297 | 607 | 1628 | oocyte and prostate | | |
| hsa-miR-298 | 608 | 1629 | | breast cancer | |
| hsa-miR-299-3p | 609 | 1630 | | myeloid leukaemia, hepatoma, breast cancer | |
| hsa-miR-299-5p | 610 | 1631 | | myeloid leukaemia, hepatoma, breast cancer | |
| hsa-miR-29a-3p | 611 | 1632 | immuno system | CLL, other cancers, neurodegenerative disease | tumor suppression, immune modulation |
| hsa-miR-29a-5p | 612 | 1633 | immuno system | CLL, other cancers, neurodegenerative disease | tumor suppression, immune modulation |
| hsa-miR-29b-1-5p | 613 | 1634 | immuno system | CLL, other cancers, neurodegenerative disease | tumor suppression, immune modulation |
| hsa-miR-29b-2-5p | 614 | 1635 | immuno system | CLL, other cancers | tumor suppression, immune modulation |
| hsa-miR-29b-3p | 615 | 1636 | immuno system | CLL, other cancers | tumor suppression, immune modulation |
| hsa-miR-29c-3p | 616 | 1637 | immuno system | CLL, other cancers | tumor suppression, |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-29c-5p | 617 | 1638 | immuno system | CLL, other cancers | immune modulation tumor suppression, immune modulation |
| hsa-miR-300 | 618 | 1639 | osteoblast | Bladder cancer | |
| hsa-miR-301a-3p | 619 | 1640 | embryonic stem cells | | |
| hsa-miR-301a-5p | 620 | 1641 | embryonic stem cells | | |
| hsa-miR-301b | 621 | 1642 | | esophageal adenocarcinoma, colonic cancer | |
| hsa-miR-302a-3p | 622 | 1643 | embryonic stem cells, lipid metabolism | | lipid metabolism |
| hsa-miR-302a-5p | 623 | 1644 | embryonic stem cells, lipid metabolism | | lipid metabolism |
| hsa-miR-302b-3p | 624 | 1645 | embryonic stem cells | | |
| hsa-miR-302b-5p | 625 | 1646 | embryonic stem cells | | |
| hsa-miR-302c-3p | 626 | 1647 | embryonic stem cells | | |
| hsa-miR-302c-5p | 627 | 1648 | embryonic stem cells | | |
| hsa-miR-302d-3p | 628 | 1649 | embryonic stem cells | | |
| hsa-miR-302d-5p | 629 | 1650 | embryonic stem cells | | |
| hsa-miR-302e | 630 | 1651 | embryoid body cells | | |
| hsa-miR-302f | 631 | 1652 | | gastric cancer | |
| hsa-miR-3064-3p | 632 | 1653 | | | |
| hsa-miR-3064-5p | 633 | 1654 | | | |
| hsa-miR-3065-3p | 634 | 1655 | oligodendrocytes | anti-virus response | |
| hsa-miR-3065-5p | 635 | 1656 | oligodendrocytes | solid tumors | |
| hsa-miR-3074-3p | 636 | 1657 | | various cancer(melanoma, breast) | |
| hsa-miR-3074-5p | 637 | 1658 | | various cancer(melanoma, breast) | |
| hsa-miR-30a-3p | 638 | 1659 | kidney, pancreatic cells | various cancers | autophagy |
| hsa-miR-30a-5p | 639 | 1660 | CNS(prefrontal cortex), other tissues | glioma, colon carcinoma | autophagy |
| hsa-miR-30b-3p | 640 | 1661 | kidney, adipose, CNS(prefrontal cortex) | | |
| hsa-miR-30b-5p | 641 | 1662 | kidney, adipose, CNS(prefrontal cortex) | | |
| hsa-miR-30c-1-3p | 642 | 1663 | kidney, adipose, CNS(prefrontal cortex) | | |
| hsa-miR-30c-2-3p | 643 | 1664 | kidney, adipose, CNS(prefrontal cortex) | | |
| hsa-miR-30c-5p | 644 | 1665 | kidney, adipose, CNS(prefrontal cortex) | | |
| hsa-miR-30d-3p | 645 | 1666 | CNS (prefrontal cortex | | |
| hsa-miR-30d-5p | 646 | 1667 | CNS (prefrontal cortex, embryoid body cells | | |
| hsa-miR-30e-3p | 647 | 1668 | myeloid cells, glia cells | | |
| hsa-miR-30e-5p | 648 | 1669 | myeloid cells, glia cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3115 | 649 | 1670 | | various cancer (melanoma, breast tumor) | |
| hsa-miR-3116 | 650 | 1671 | discovered in the melanoma miRNAome | | |
| hsa-miR-3117-3p | 651 | 1672 | discovered in the melanoma miRNAome | | |
| hsa-miR-3117-5p | 652 | 1673 | discovered in the melanoma miRNAome | | |
| hsa-miR-3118 | 653 | 1674 | discovered in the melanoma miRNAome | | |
| hsa-miR-3119 | 654 | 1675 | discovered in the melanoma miRNAome | | |
| hsa-miR-3120-3p | 655 | 1676 | discovered in the melanoma miRNAome | breast tumor | |
| hsa-miR-3120-5p | 656 | 1677 | discovered in the melanoma miRNAome | breast tumor | |
| hsa-miR-3121-3p | 657 | 1678 | discovered in the melanoma miRNAome | breast tumor | |
| hsa-miR-3121-5p | 658 | 1679 | discovered in the melanoma miRNAome | breast tumor | |
| hsa-miR-3122 | 659 | 1680 | discovered in the melanoma miRNAome | | |
| hsa-miR-3123 | 660 | 1681 | discovered in the melanoma miRNAome | | |
| hsa-miR-3124-3p | 661 | 1682 | discovered in melanoma miRNAome, ovary | the breast tumor | |
| hsa-miR-3124-5p | 662 | 1683 | discovered in the melanoma miRNAome, ovary | breast tumor | |
| hsa-miR-3125 | 663 | 1684 | discovered in the melanoma miRNAome | | |
| hsa-miR-3126-3p | 664 | 1685 | discovered in the melanoma miRNAome, ovary | breast tumor | |
| hsa-miR-3126-5p | 665 | 1686 | discovered in the melanoma miRNAome, ovary | breast tumor | |
| hsa-miR-3127-3p | 666 | 1687 | discovered in the melanoma miRNAome | breast tumor | |
| hsa-miR-3127-5p | 667 | 1688 | discovered in the melanoma miRNAome | breast tumor | |
| hsa-miR-3128 | 668 | 1689 | discovered in the melanoma miRNAome | breast tumor | |
| hsa-miR-3129-3p | 669 | 1690 | discovered in the melanoma miRNAome, ovary | breast tumor | |
| hsa-miR-3129-5p | 670 | 1691 | discovered in the melanoma miRNAome, ovary | breast tumor | |
| hsa-miR-3130-3p | 671 | 1692 | discovered in the melanoma miRNAome, ovary | breast tumor | |
| hsa-miR-3130-5p | 672 | 1693 | discovered in the melanoma miRNAome, ovary | breast tumor | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3131 | 673 | 1694 | discovered in the melanoma miRNAome | breast tumor | |
| hsa-miR-3132 | 674 | 1695 | discovered in the melanoma miRNAome | | |
| hsa-miR-3133 | 675 | 1696 | discovered in the melanoma miRNAome | | |
| hsa-miR-3134 | 676 | 1697 | discovered in the melanoma miRNAome | | |
| hsa-miR-3135a | 677 | 1698 | discovered in the melanoma miRNAome | | |
| hsa-miR-3135b | 678 | 1699 | discovered in B cells | | |
| hsa-miR-3136-3p | 679 | 1700 | discovered in the melanoma miRNAome | lymphoblastic leukaemia and breast tumor | |
| hsa-miR-3136-5p | 680 | 1701 | discovered in the melanoma miRNAome | lymphoblastic leukaemia and breast tumor | |
| hsa-miR-3137 | 681 | 1702 | discovered in the melanoma miRNAome | | |
| hsa-miR-3138 | 682 | 1703 | discovered in the melanoma miRNAome, ovary | | |
| hsa-miR-3139 | 683 | 1704 | discovered in the melanoma miRNAome | | |
| hsa-miR-31-3p | 684 | 1705 | | | |
| hsa-miR-3140-3p | 685 | 1706 | discovered in the melanoma miRNAome, ovary | lymphoblastic leukaemia and breast tumor | |
| hsa-miR-3140-5p | 686 | 1707 | discovered in the melanoma miRNAome, ovary | lymphoblastic leukaemia and breast tumor | |
| hsa-miR-3141 | 687 | 1708 | discovered in the melanoma miRNAome | | |
| hsa-miR-3142 | 688 | 1709 | discovered in the melanoma miRNAome; immune cells | | |
| hsa-miR-3143 | 689 | 1710 | discovered in the melanoma miRNAome | breast tumor | |
| hsa-miR-3144-3p | 690 | 1711 | discovered in the melanoma miRNAome, ovary | | |
| hsa-miR-3144-5p | 691 | 1712 | discovered in the melanoma miRNAome, ovary | | |
| hsa-miR-3145-3p | 692 | 1713 | discovered in the melanoma miRNAome | breast tumor | |
| hsa-miR-3145-5p | 693 | 1714 | discovered in the melanoma miRNAome | breast tumor | |
| hsa-miR-3146 | 694 | 1715 | discovered in the melanoma miRNAome | breast tumor | |
| hsa-miR-3147 | 695 | 1716 | discovered in the melanoma miRNAome | | |
| hsa-miR-3148 | 696 | 1717 | discovered in the melanoma miRNAome | | |
| hsa-miR-3149 | 697 | 1718 | discovered in the melanoma miRNAome, ovary | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3150a-3p | 698 | 1719 | discovered in the melanoma miRNAome | breast tumor | |
| hsa-miR-3150a-5p | 699 | 1720 | discovered in the melanoma miRNAome | breast tumor | |
| hsa-miR-3150b-3p | 700 | 1721 | discovered in the melanoma miRNAome | breast tumor and lymphoblastic leukaemia | |
| hsa-miR-3150b-5p | 701 | 1722 | discovered in the melanoma miRNAome | breast tumor and lymphoblastic leukaemia | |
| hsa-miR-3151 | 702 | 1723 | discovered in the melanoma miRNAome | lymphoblastic leukaemia | |
| hsa-miR-3152-3p | 703 | 1724 | discovered in the melanoma miRNAome, ovary | breast tumor | |
| hsa-miR-3152-5p | 704 | 1725 | discovered in the melanoma miRNAome, ovary | breast tumor | |
| hsa-miR-3153 | 705 | 1726 | discovered in the melanoma miRNAome | | |
| hsa-miR-3154 | 706 | 1727 | discovered in the melanoma miRNAome | lymphoblastic leukaemia | |
| hsa-miR-3155a | 707 | 1728 | discovered in the melanoma miRNAome | | |
| hsa-miR-3155b | 708 | 1729 | discovered in B cells | | |
| hsa-miR-3156-3p | 709 | 1730 | discovered in the melanoma miRNAome | breast tumor | |
| hsa-miR-3156-5p | 710 | 1731 | discovered in the melanoma miRNAome | breast tumor | |
| hsa-miR-3157-3p | 711 | 1732 | discovered in the melanoma miRNAome | breast tumor | |
| hsa-miR-3157-5p | 712 | 1733 | discovered in the melanoma miRNAome | breast tumor | |
| hsa-miR-3158-3p | 713 | 1734 | discovered in the melanoma miRNAome, ovary | breast tumor | |
| hsa-miR-3158-5p | 714 | 1735 | discovered in the melanoma miRNAome, ovary | breast tumor | |
| hsa-miR-3159 | 715 | 1736 | discovered in the melanoma miRNAome | | |
| hsa-miR-31-5p | 716 | 1737 | | various cancer cells (breast, lung, prostate) | |
| hsa-miR-3160-3p | 717 | 1738 | discovered in the melanoma miRNAome | breast tumor | |
| hsa-miR-3160-5p | 718 | 1739 | discovered in the melanoma miRNAome | breast tumor | |
| hsa-miR-3161 | 719 | 1740 | discovered in the melanoma miRNAome | | |
| hsa-miR-3162-3p | 720 | 1741 | discovered in the melanoma miRNAome | breast tumor | |
| hsa-miR-3162-5p | 721 | 1742 | discovered in the melanoma miRNAome | breast tumor | |
| hsa-miR-3163 | 722 | 1743 | discovered in the melanoma miRNAome | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3164 | 723 | 1744 | discovered in the melanoma miRNAome | | |
| hsa-miR-3165 | 724 | 1745 | discovered in the melanoma miRNAome | breast tumor | |
| hsa-miR-3166 | 725 | 1746 | discovered in the melanoma miRNAome | | |
| hsa-miR-3167 | 726 | 1747 | discovered in the melanoma miRNAome, ovary | | |
| hsa-miR-3168 | 727 | 1748 | discovered in the melanoma miRNAome | | |
| hsa-miR-3169 | 728 | 1749 | discovered in the melanoma miRNAome | | |
| hsa-miR-3170 | 729 | 1750 | discovered in the melanoma miRNAome | breast tumor | |
| hsa-miR-3171 | 730 | 1751 | discovered in the melanoma miRNAome, ovary | | |
| hsa-miR-3173-3p | 731 | 1752 | discovered in the melanoma miRNAome | breast tumor | |
| hsa-miR-3173-5p | 732 | 1753 | discovered in the melanoma miRNAome | breast tumor | |
| hsa-miR-3174 | 733 | 1754 | discovered in the melanoma miRNAome | | |
| hsa-miR-3175 | 734 | 1755 | discovered in the melanoma miRNAome, ovary | breast tumor | |
| hsa-miR-3176 | 735 | 1756 | discovered in the melanoma miRNAome | breast tumor | |
| hsa-miR-3177-3p | 736 | 1757 | discovered in the melanoma miRNAome | breast tumor and lymphoblastic leukaemia | |
| hsa-miR-3177-5p | 737 | 1758 | discovered in the melanoma miRNAome | breast tumor and lymphoblastic leukaemia | |
| hsa-miR-3178 | 738 | 1759 | discovered in the melanoma miRNAome | | |
| hsa-miR-3179 | 739 | 1760 | discovered in the melanoma miRNAome | | |
| hsa-miR-3180 | 740 | 1761 | discovered in the melanoma miRNAome, ovary | breast tumor | |
| hsa-miR-3180-3p | 741 | 1762 | discovered in breast tunor | | |
| hsa-miR-3180-5p | 742 | 1763 | discovered in breast tumor | | |
| hsa-miR-3181 | 743 | 1764 | discovered in the melanoma miRNAome | | |
| hsa-miR-3182 | 744 | 1765 | discovered in the melanoma miRNAome | | |
| hsa-miR-3183 | 745 | 1766 | discovered in the melanoma miRNAome | | |
| hsa-miR-3184-3p | 746 | 1767 | discovered in the melanoma miRNAome | | |
| hsa-miR-3184-5p | 747 | 1768 | discovered in the melanoma miRNAome | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3185 | 748 | 1769 | discovered in the melanoma miRNAome | | |
| hsa-miR-3186-3p | 749 | 1770 | discovered in the melanoma miRNAome, ovary | | |
| hsa-miR-3186-5p | 750 | 1771 | discovered in the melanoma miRNAome, ovary | | |
| hsa-miR-3187-3p | 751 | 1772 | discovered in the melanoma miRNAome | breast tumor | |
| hsa-miR-3187-5p | 752 | 1773 | discovered in the melanoma miRNAome | breast tumor | |
| hsa-miR-3188 | 753 | 1774 | discovered in the melanoma miRNAome | | |
| hsa-miR-3189-3p | 754 | 1775 | discovered in the melanoma miRNAome | breast tumor | |
| hsa-miR-3189-5p | 755 | 1776 | discovered in the melanoma miRNAome | breast tumor | |
| hsa-miR-3190-3p | 756 | 1777 | discovered in the melanoma miRNAome | lymphoblastic leukaemia | |
| hsa-miR-3190-5p | 757 | 1778 | discovered in the melanoma miRNAome | lymphoblastic leukaemia | |
| hsa-miR-3191-3p | 758 | 1779 | discovered in the melanoma miRNAome | | |
| hsa-miR-3191-5p | 759 | 1780 | discovered in the melanoma miRNAome | | |
| hsa-miR-3192 | 760 | 1781 | discovered in the melanoma miRNAome | breast tumor | |
| hsa-miR-3193 | 761 | 1782 | discovered in the melanoma miRNAome | | |
| hsa-miR-3194-3p | 762 | 1783 | discovered in the melanoma miRNAome | breast tumor | |
| hsa-miR-3194-5p | 763 | 1784 | discovered in the melanoma miRNAome | breast tumor | |
| hsa-miR-3195 | 764 | 1785 | discovered in the melanoma miRNAome | | |
| hsa-miR-3196 | 765 | 1786 | | basal cell carcinoma | |
| hsa-miR-3197 | 766 | 1787 | discovered in the melanoma miRNAome | | |
| hsa-miR-3198 | 767 | 1788 | discovered in the melanoma miRNAome | breast tumor | |
| hsa-miR-3199 | 768 | 1789 | discovered in the melanoma miRNAome | | |
| hsa-miR-3200-3p | 769 | 1790 | discovered in the melanoma miRNAome, ovary | breast tumor | |
| hsa-miR-3200-5p | 770 | 1791 | discovered in the melanoma miRNAome, ovary | breast tumor | |
| hsa-miR-3201 | 771 | 1792 | discovered in the melanoma miRNAome, | | |
| hsa-miR-3202 | 772 | 1793 | discovered in the melanoma | | |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | miRNAome, epithelial cell BEAS2B | | |
| hsa-miR-320a | 773 | 1794 | blood, heart(myocardiac) | colon cancer cells, heart disease | |
| hsa-miR-320b | 774 | 1795 | central nevous system | | |
| hsa-miR-320c | 775 | 1796 | chondrocyte | | cartilage metabolism |
| hsa-miR-320d | 776 | 1797 | | cancer stem cells | |
| hsa-miR-320e | 777 | 1798 | neural cells | | |
| hsa-miR-323a-3p | 778 | 1799 | neurons | myeloid leukaemia, mudulla thyroid carcinoma | |
| hsa-miR-323a-5p | 779 | 1800 | neurons | myeloid leukaemia, mudulla thyroid carcinoma | |
| hsa-miR-323b-3p | 780 | 1801 | | myeloid leukaemia | |
| hsa-miR-323b-5p | 781 | 1802 | | myeloid leukaemia | |
| hsa-miR-32-3p | 782 | 1803 | blood, glia | various cancers (lung, kidney, prostate, etc), virus infection | |
| hsa-miR-324-3p | 783 | 1804 | kidney | | |
| hsa-miR-324-5p | 784 | 1805 | neurons | tumor cells | |
| hsa-miR-325 | 785 | 1806 | neurons, placenta | | |
| hsa-miR-32-5p | 786 | 1807 | blood, glia | various cancers (lung, kidney, prostate, etc), virus infection | |
| hsa-miR-326 | 787 | 1808 | neurons | tumor cells | |
| hsa-miR-328 | 788 | 1809 | neuron, blood | tumor cells | |
| hsa-miR-329 | 789 | 1810 | brain and platele | | |
| hsa-miR-330-3p | 790 | 1811 | | various cancers (prostate, glioblastoma, colorectal) | |
| hsa-miR-330-5p | 791 | 1812 | | various cancers (prostate, glioblastoma, colorectal) | |
| hsa-miR-331-3p | 792 | 1813 | | gastric cancer | |
| hsa-miR-331-5p | 793 | 1814 | lymphocytes | | |
| hsa-miR-335-3p | 794 | 1815 | kidney, breast | RCC, multiple myeloma | |
| hsa-miR-335-5p | 795 | 1816 | kidney, breast | RCC, multiple myeloma | |
| hsa-miR-337-3p | 796 | 1817 | lung | gastric cancer | |
| hsa-miR-337-5p | 797 | 1818 | lung | | |
| hsa-miR-338-3p | 798 | 1819 | epithelial cells, oligodendrocytes | gastric, rectal cancer cells, osteosarcoma | |
| hsa-miR-338-5p | 799 | 1820 | oligodendrocytes | gastric cancer | |
| hsa-miR-339-3p | 800 | 1821 | immune cell | | |
| hsa-miR-339-5p | 801 | 1822 | immune cell | | |
| hsa-miR-33a-3p | 802 | 1823 | pancreatic islet, lipid metabolism | | lipid metabolism |
| hsa-miR-33a-5p | 803 | 1824 | pancreatic islet, lipid metabolism | | lipid metabolism |
| hsa-miR-33b-3p | 804 | 1825 | lipid metabolism | | lipid metabolism |
| hsa-miR-33b-5p | 805 | 1826 | lipid metabolism | | lipid metabolism |
| hsa-miR-340-3p | 806 | 1827 | | various cancers | |
| hsa-miR-340-5p | 807 | 1828 | embryoid body cells | | |
| hsa-miR-342-3p | 808 | 1829 | brain, circulating plasma | multiple myeloma, other cancers | |
| hsa-miR-342-5p | 809 | 1830 | circulating plasma | multiple myeloma, other cancers | |
| hsa-miR-345-3p | 810 | 1831 | hematopoietic cells | follicular lymphoma, other cancers | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-345-5p | 811 | 1832 | hematopoietic cells | follicular lymphoma, other cancers | |
| hsa-miR-346 | 812 | 1833 | immume cells | cancers and autoimmune | |
| hsa-miR-34a-3p | 813 | 1834 | breast, meyloid cells, ciliated epithelial cells | gastric cancer, CLL, other | tumor suppressor, p53 inducible |
| hsa-miR-34a-5p | 814 | 1835 | breast, meyloid cells, ciliated epithelial cells | gastric cancer, CLL, other | tumor suppressor, p53 inducible |
| hsa-miR-34b-3p | 815 | 1836 | ciliated epithelial cells | various cancers | tumor suppressor, p53 inducible |
| hsa-miR-34b-5p | 816 | 1837 | ciliated epithelial cells | various cancers | tumor suppressor, p53 inducible |
| hsa-miR-34c-3p | 817 | 1838 | ciliated epithelial cells, placenta | various cancers | tumor suppressor, p53 inducible |
| hsa-miR-34c-5p | 818 | 1839 | ciliated epithelial cells, placenta | various cancers | tumor suppressor, p53 inducible |
| hsa-miR-3529-3p | 819 | 1840 | discovered in breast tumor | | |
| hsa-miR-3529-5p | 820 | 1841 | discovered in breast tumor | | |
| hsa-miR-3591-3p | 821 | 1842 | discovered in breast tumor | | |
| hsa-miR-3591-5p | 822 | 1843 | discovered in breast tumor | | |
| hsa-miR-3605-3p | 823 | 1844 | discovered in reprodcutive tracts | | |
| hsa-miR-3605-5p | 824 | 1845 | discovered in reprodcutive tracts | | |
| hsa-miR-3606-3p | 825 | 1846 | discovered in cervical tumors | | |
| hsa-miR-3606-5p | 826 | 1847 | discovered in cervical tumors | | |
| hsa-miR-3607-3p | 827 | 1848 | discovered in cervical tumors | | |
| hsa-miR-3607-5p | 828 | 1849 | discovered in cervical tumors | | |
| hsa-miR-3609 | 829 | 1850 | discovered in cervical tumors | | |
| hsa-miR-3610 | 830 | 1851 | discovered in cervical tumors | | |
| hsa-miR-3611 | 831 | 1852 | discovered in cervical tumors | | |
| hsa-miR-3612 | 832 | 1853 | discovered in cervical tumors | | |
| hsa-miR-3613-3p | 833 | 1854 | discovered in cervical tumors | | |
| hsa-miR-3613-5p | 834 | 1855 | discovered in cervical tumors | | |
| hsa-miR-361-3p | 835 | 1856 | blood, endothelial cells | | |
| hsa-miR-3614-3p | 836 | 1857 | discovered in cervical and breast tumors | | |
| hsa-miR-3614-5p | 837 | 1858 | discovered in cervical and breast tumors | | |
| hsa-miR-3615 | 838 | 1859 | discovered in cervical tumors | | |
| hsa-miR-361-5p | 839 | 1860 | endothelial cells | | |
| hsa-miR-3616-3p | 840 | 1861 | discovered in cervical tumors | | |
| hsa-miR-3616-5p | 841 | 1862 | discovered in cervical tumors | | |
| hsa-miR-3617-3p | 842 | 1863 | discovered in cervical tumors and psoriasis | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3617-5p | 843 | 1864 | discovered in cervical tumors and psoriasis | | |
| hsa-miR-3618 | 844 | 1865 | discovered in cervical tumors | | |
| hsa-miR-3619-3p | 845 | 1866 | discovered in breast tumors | | |
| hsa-miR-3619-5p | 846 | 1867 | discovered in breast tumors | | |
| hsa-miR-3620-3p | 847 | 1868 | discovered in cervical tumors | | |
| hsa-miR-3620-5p | 848 | 1869 | discovered in cervical tumors | | |
| hsa-miR-3621 | 849 | 1870 | discovered in cervical tumors | | |
| hsa-miR-3622a-3p | 850 | 1871 | discovered in breast tumors | | |
| hsa-miR-3622a-5p | 851 | 1872 | discovered in breast tumors | | |
| hsa-miR-3622b-3p | 852 | 1873 | discovered in cervical tumors | | |
| hsa-miR-3622b-5p | 853 | 1874 | discovered in cervical tumors | | |
| hsa-miR-362-3p | 854 | 1875 | | melanoma | |
| hsa-miR-362-5p | 855 | 1876 | | melanoma | |
| hsa-miR-363-3p | 856 | 1877 | kidney stem cell, blood cells | | |
| hsa-miR-363-5p | 857 | 1878 | kidney stem cell, blood cells | | |
| hsa-miR-3646 | 858 | 1879 | discovered in solid tumor | | |
| hsa-miR-3648 | 859 | 1880 | discovered in solid tumor | | |
| hsa-miR-3649 | 860 | 1881 | discovered in solid tumor | | |
| hsa-miR-3650 | 861 | 1882 | discovered in solid tumor | | |
| hsa-miR-3651 | 862 | 1883 | discovered in solid tumor | | |
| hsa-miR-3652 | 863 | 1884 | discovered in solid tumor | | |
| hsa-miR-3653 | 864 | 1885 | discovered in solid tumor | | |
| hsa-miR-3654 | 865 | 1886 | discovered in solid tumor | | |
| hsa-miR-3655 | 866 | 1887 | discovered in solid tumor | | |
| hsa-miR-3656 | 867 | 1888 | discovered in solid tumor | | |
| hsa-miR-3657 | 868 | 1889 | discovered in solid tumor | | |
| hsa-miR-3658 | 869 | 1890 | discovered in solid tumor | | |
| hsa-miR-3659 | 870 | 1891 | discovered in breast tumors | | |
| hsa-miR-365a-3p | 871 | 1892 | | various cancer cells (Immune cells, lung, colon, endometriotic) | apoptosis |
| hsa-miR-365a-5p | 872 | 1893 | | various cancer cells (Immune cells, lung, colon, endometriotic)) | apoptosis |
| hsa-miR-365b-3p | 873 | 1894 | | various cancers (retinoblastoma, colon, endometriotic) | apoptosis |
| hsa-miR-365b-5p | 874 | 1895 | | various cancers (colon, endometriotic) | apoptosis |
| hsa-miR-3660 | 875 | 1896 | discovered in breast tumors | | |
| hsa-miR-3661 | 876 | 1897 | discovered in breast tumors | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3662 | 877 | 1898 | — | | |
| hsa-miR-3663-3p | 878 | 1899 | — | | |
| hsa-miR-3663-5p | 879 | 1900 | — | | |
| hsa-miR-3664-3p | 880 | 1901 | discovered in breast tumors | | |
| hsa-miR-3664-5p | 881 | 1902 | discovered in breast tumors | | |
| hsa-miR-3665 | 882 | 1903 | brain | | |
| hsa-miR-3666 | 883 | 1904 | brain | | |
| hsa-miR-3667-3p | 884 | 1905 | discovered in peripheral blood | | |
| hsa-miR-3667-5p | 885 | 1906 | discovered in peripheral blood | | |
| hsa-miR-3668 | 886 | 1907 | discovered in peripheral blood | | |
| hsa-miR-3669 | 887 | 1908 | discovered in peripheral blood | | |
| hsa-miR-3670 | 888 | 1909 | discovered in peripheral blood | | |
| hsa-miR-3671 | 889 | 1910 | discovered in peripheral blood | | |
| hsa-miR-3672 | 890 | 1911 | discovered in peripheral blood | | |
| hsa-miR-3673 | 891 | 1912 | discovered in peripheral blood | | |
| hsa-miR-367-3p | 892 | 1913 | embryonic stem cells | | reprogramming |
| hsa-miR-3674 | 893 | 1914 | discovered in peripheral blood | | |
| hsa-miR-3675-3p | 894 | 1915 | discovered in peripheral blood | | |
| hsa-miR-3675-5p | 895 | 1916 | discovered in peripheral blood | | |
| hsa-miR-367-5p | 896 | 1917 | embryonic stem cells | | reprogramming |
| hsa-miR-3676-3p | 897 | 1918 | discovered in peripheral blood | | |
| hsa-miR-3676-5p | 898 | 1919 | discovered in peripheral blood | | |
| hsa-miR-3677-3p | 899 | 1920 | discovered in peripheral blood | | |
| hsa-miR-3677-5p | 900 | 1921 | discovered in peripheral blood | | |
| hsa-miR-3678-3p | 901 | 1922 | discovered in peripheral blood | | |
| hsa-miR-3678-5p | 902 | 1923 | discovered in peripheral blood | | |
| hsa-miR-3679-3p | 903 | 1924 | discovered in peripheral blood | | |
| hsa-miR-3679-5p | 904 | 1925 | discovered in peripheral blood | | |
| hsa-miR-3680-3p | 905 | 1926 | discovered in peripheral blood | | |
| hsa-miR-3680-5p | 906 | 1927 | discovered in peripheral blood | | |
| hsa-miR-3681-3p | 907 | 1928 | discovered in peripheral blood | | |
| hsa-miR-3681-5p | 908 | 1929 | discovered in peripheral blood | | |
| hsa-miR-3682-3p | 909 | 1930 | discovered in peripheral blood | | |
| hsa-miR-3682-5p | 910 | 1931 | discovered in peripheral blood | | |
| hsa-miR-3683 | 911 | 1932 | discovered in peripheral blood | | |
| hsa-miR-3684 | 912 | 1933 | discovered in peripheral blood | | |
| hsa-miR-3685 | 913 | 1934 | discovered in peripheral blood | | |
| hsa-miR-3686 | 914 | 1935 | discovered in peripheral blood | | |
| hsa-miR-3687 | 915 | 1936 | discovered in peripheral blood | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3688-3p | 916 | 1937 | discovered in breast tumor | | |
| hsa-miR-3688-5p | 917 | 1938 | discovered in breast tumor | | |
| hsa-miR-3689a-3p | 918 | 1939 | discovered in female reproductuve tract | | |
| hsa-miR-3689a-5p | 919 | 1940 | discovered in female reproductuve tract and peripheral blood | | |
| hsa-miR-3689b-3p | 920 | 1941 | discovered in female reproductuve tract and peripheral blood | | |
| hsa-miR-3689b-5p | 921 | 1942 | discovered in female reproductuve tract | | |
| hsa-miR-3689c | 922 | 1943 | discovered in B cells | | |
| hsa-miR-3689d | 923 | 1944 | discovered in B cells | | |
| hsa-miR-3689e | 924 | 1945 | discovered in B cells | | |
| hsa-miR-3689f | 925 | 1946 | discovered in B cells | | |
| hsa-miR-3690 | 926 | 1947 | discovered in peripheral blood | | |
| hsa-miR-3691-3p | 927 | 1948 | discovered in peripheral blood | | |
| hsa-miR-3691-5p | 928 | 1949 | discovered in peripheral blood | | |
| hsa-miR-3692-3p | 929 | 1950 | discovered in peripheral blood | | |
| hsa-miR-3692-5p | 930 | 1951 | discovered in peripheral blood | | |
| hsa-miR-369-3p | 931 | 1952 | stem cells | | reprogramming |
| hsa-miR-369-5p | 932 | 1953 | stem cells | | reprogramming |
| hsa-miR-370 | 933 | 1954 | | acute meyloid leukaemia and other cancers | tumor suppressor, lipid metabolism |
| hsa-miR-3713 | 934 | 1955 | discovered in neuroblastoma | | |
| hsa-miR-3714 | 935 | 1956 | discovered in neuroblastoma | | |
| hsa-miR-371a-3p | 936 | 1957 | serum | | |
| hsa-miR-371a-5p | 937 | 1958 | serum | | |
| hsa-miR-371b-3p | 938 | 1959 | serum | | |
| hsa-miR-371b-5p | 939 | 1960 | serum | | |
| hsa-miR-372 | 940 | 1961 | hematopoietic cells, lung, placental (blood) | | |
| hsa-miR-373-3p | 941 | 1962 | | breast cancer | |
| hsa-miR-373-5p | 942 | 1963 | | breast cancer | |
| hsa-miR-374a-3p | 943 | 1964 | muscle (myoblasts) | breast and lung cancer | myogenic differentiation |
| hsa-miR-374a-5p | 944 | 1965 | muscle (myoblasts) | breast and lung cancer | myogenic differentiation |
| hsa-miR-374b-3p | 945 | 1966 | muscle (myoblasts) | | myogenic differentiation |
| hsa-miR-374b-5p | 946 | 1967 | muscle (myoblasts) | | myogenic differentiation |
| hsa-miR-374c-3p | 947 | 1968 | muscle (myoblasts) | | myogenic differentiation |
| hsa-miR-374c-5p | 948 | 1969 | muscle (myoblasts) | | myogenic differentiation |
| hsa-miR-375 | 949 | 1970 | pancreas (islet) | | |
| hsa-miR-376a-2-5p | 950 | 1971 | regulatory miRs for hematopoietic cells (erythroid, platelet, lympho) | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-376a-3p | 951 | 1972 | regulatory miRs for hematopoietic cells (erythroid, platelet, lympho) | | |
| hsa-miR-376a-5p | 952 | 1973 | regulatory miRs for hematopoietic cells (erythroid, platelet, lympho) | | |
| hsa-miR-376b-3p | 953 | 1974 | blood | various cancer cells | autophagy |
| hsa-miR-376b-5p | 954 | 1975 | blood | various cancer cells | autophagy |
| hsa-miR-376c-3p | 955 | 1976 | trophoblast | various cancer cells | cell proliferatio |
| hsa-miR-376c-5p | 956 | 1977 | trophoblast | various cancer cells | cell proliferatio |
| hsa-miR-377-3p | 957 | 1978 | hematopoietic cells | | |
| hsa-miR-377-5p | 958 | 1979 | hematopoietic cells | | |
| hsa-miR-378a-3p | 959 | 1980 | ovary, lipid metabolism | | |
| hsa-miR-378a-5p | 960 | 1981 | ovary, placenta/trophoblast, lipid metabolism | | |
| hsa-miR-378b | 961 | 1982 | lipid metabolism | | |
| hsa-miR-378c | 962 | 1983 | lipid metabolism | | |
| hsa-miR-378d | 963 | 1984 | lipid metabolism | | |
| hsa-miR-378e | 964 | 1985 | lipid metabolism | | |
| hsa-miR-378f | 965 | 1986 | lipid metabolism | | |
| hsa-miR-378g | 966 | 1987 | lipid metabolism | | |
| hsa-miR-378h | 967 | 1988 | lipid metabolism | | |
| hsa-miR-378i | 968 | 1989 | lipid metabolism | | |
| hsa-miR-378j | 969 | 1990 | lipid metabolism | | |
| hsa-miR-379-3p | 970 | 1991 | | various cancers (breast, hepatocytes, colon) | |
| hsa-miR-379-5p | 971 | 1992 | | various cancers (breast, hepatocytes, colon) | |
| hsa-miR-380-3p | 972 | 1993 | brain | neuroblastoma | |
| hsa-miR-380-5p | 973 | 1994 | brain, embryonic stem cells | neuroblastoma | |
| hsa-miR-381-3p | 974 | 1995 | chondrogenesis, lung, brain | | |
| hsa-miR-381-5p | 975 | 1996 | chondrogenesis, lung, brain | | |
| hsa-miR-382-3p | 976 | 1997 | renal epithelial cells | | |
| hsa-miR-382-5p | 977 | 1998 | renal epithelial cells | | |
| hsa-miR-383 | 978 | 1999 | testes, brain (medulla) | | |
| hsa-miR-384 | 979 | 2000 | epithelial cells | | |
| hsa-miR-3907 | 980 | 2001 | discovered in female reproductive tract | | |
| hsa-miR-3908 | 981 | 2002 | discovered in female reproductive tract | | |
| hsa-miR-3909 | 982 | 2003 | discovered in female reproductive tract | | |
| hsa-miR-3910 | 983 | 2004 | discovered in female reproductive tract | | |
| hsa-miR-3911 | 984 | 2005 | discovered in breast tumor and | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3912 | 985 | 2006 | discovered in female reproductive tract | | |
| hsa-miR-3913-3p | 986 | 2007 | discovered in breast tumor and female reproductive tract | | |
| hsa-miR-3913-5p | 987 | 2008 | discovered in breast tumor and female reproductive tract | | |
| hsa-miR-3914 | 988 | 2009 | discovered in breast tumor and female reproductive tract | | |
| hsa-miR-3915 | 989 | 2010 | discovered in female reproductive tract | | |
| hsa-miR-3916 | 990 | 2011 | discovered in female reproductive tract | | |
| hsa-miR-3917 | 991 | 2012 | discovered in female reproductive tract | | |
| hsa-miR-3918 | 992 | 2013 | discovered in female reproductive tract | | |
| hsa-miR-3919 | 993 | 2014 | discovered in female reproductive tract | | |
| hsa-miR-3920 | 994 | 2015 | discovered in female reproductive tract | | |
| hsa-miR-3921 | 995 | 2016 | discovered in female reproductive tract | | |
| hsa-miR-3922-3p | 996 | 2017 | discovered in breast tumor and female reproductive tract | | |
| hsa-miR-3922-5p | 997 | 2018 | discovered in breast tumor and female reproductive tract | | |
| hsa-miR-3923 | 998 | 2019 | discovered in female reproductive tract | | |
| hsa-miR-3924 | 999 | 2020 | discovered in female reproductive tract | | |
| hsa-miR-3925-3p | 1000 | 2021 | discovered in breast tumor and female reproductive tract | | |
| hsa-miR-3925-5p | 1001 | 2022 | discovered in breast tumor and female reproductive tract | | |
| hsa-miR-3926 | 1002 | 2023 | discovered in female reproductive tract | | |
| hsa-miR-3927-3p | 1003 | 2024 | discovered in female reproductive tract and psoriasis | | |
| hsa-miR-3927-5p | 1004 | 2025 | discovered in female reproductive tract and psoriasis | | |
| hsa-miR-3928 | 1005 | 2026 | discovered in female reproductive tract | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-3929 | 1006 | 2027 | discovered in female reproductive tract | | |
| hsa-miR-3934-3p | 1007 | 2028 | discovered in abnormal skin (psoriasis) | | |
| hsa-miR-3934-5p | 1008 | 2029 | discovered in abnormal skin (psoriasis) | | |
| hsa-miR-3935 | 1009 | 2030 | | | |
| hsa-miR-3936 | 1010 | 2031 | discovered in breast tumor and lymphoblastic leukaemia | | |
| hsa-miR-3937 | 1011 | 2032 | | | |
| hsa-miR-3938 | 1012 | 2033 | | | |
| hsa-miR-3939 | 1013 | 2034 | | | |
| hsa-miR-3940-3p | 1014 | 2035 | discovered in breast tumor | | |
| hsa-miR-3940-5p | 1015 | 2036 | discovered in breast tumor | | |
| hsa-miR-3941 | 1016 | 2037 | | | |
| hsa-miR-3942-3p | 1017 | 2038 | discovered in breast tumor and lymphoblastic leukaemia | | |
| hsa-miR-3942-5p | 1018 | 2039 | discovered in breast tumor and lymphoblastic leukaemia | | |
| hsa-miR-3943 | 1019 | 2040 | | | |
| hsa-miR-3944-3p | 1020 | 2041 | discovered in breast tumor | | |
| hsa-miR-3944-5p | 1021 | 2042 | discovered in breast tumor | | |
| hsa-miR-3945 | 1022 | 2043 | | | |
| hsa-miR-3960 | 1023 | 2044 | osteoblast | | |
| hsa-miR-3972 | 1024 | 2045 | discovered in Acute Myeloid Leukaemia | | |
| hsa-miR-3973 | 1025 | 2046 | discovered in Acute Myeloid Leukaemia | | |
| hsa-miR-3974 | 1026 | 2047 | discovered in Acute Myeloid Leukaemia | | |
| hsa-miR-3975 | 1027 | 2048 | discovered in Acute Myeloid Leukaemia | | |
| hsa-miR-3976 | 1028 | 2049 | discovered in Acute Myeloid Leukaemia | | |
| hsa-miR-3977 | 1029 | 2050 | discovered in Acute Myeloid Leukaemia | | |
| hsa-miR-3978 | 1030 | 2051 | discovered in Acute Myeloid Leukaemia | | |
| hsa-miR-409-3p | 1031 | 2052 | | gastric cancer | |
| hsa-miR-409-5p | 1032 | 2053 | | gastric cancer | |
| hsa-miR-410 | 1033 | 2054 | brain | glioma | |
| hsa-miR-411-3p | 1034 | 2055 | | Glioblastoma others | |
| hsa-miR-411-5p | 1035 | 2056 | | Glioblastoma others | |
| hsa-miR-412 | 1036 | 2057 | | upregulated in lung cancer | |
| hsa-miR-421 | 1037 | 2058 | endothelial cells | gastric cancer, HCC | |
| hsa-miR-422a | 1038 | 2059 | circulating microRNA (in plasma) | | |
| hsa-miR-423-3p | 1039 | 2060 | embryonic stem cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-423-5p | 1040 | 2061 | heart, embryonic stem cells | | |
| hsa-miR-424-3p | 1041 | 2062 | endothelial cells | various cancers(e.g B-lieage ALL), cardiac diseases | pro-angiogenic |
| hsa-miR-424-5p | 1042 | 2063 | endothelial cells | various cancers(e.g B-lieage ALL), cardiac diseases | pro-angiogenic |
| hsa-miR-4251 | 1043 | 2064 | discovered in embryonic stem cells and neural precusors | | |
| hsa-miR-4252 | 1044 | 2065 | discovered in embryonic stem cells and neural precusors | | |
| hsa-miR-4253 | 1045 | 2066 | discovered in embryonic stem cells and neural precusors | | |
| hsa-miR-425-3p | 1046 | 2067 | brain | ovarian cancer, brain tumor | |
| hsa-miR-4254 | 1047 | 2068 | discovered in embryonic stem cells and neural precusors | | |
| hsa-miR-4255 | 1048 | 2069 | discovered in embryonic stem cells and neural precusors | | |
| hsa-miR-425-5p | 1049 | 2070 | brain | B-lieage ALL, brain tumor | |
| hsa-miR-4256 | 1050 | 2071 | discovered in embryonic stem cells and neural precusors | | |
| hsa-miR-4257 | 1051 | 2072 | discovered in embryonic stem cells and neural precusors | | |
| hsa-miR-4258 | 1052 | 2073 | discovered in embryonic stem cells and neural precusors | | |
| hsa-miR-4259 | 1053 | 2074 | discovered in embryonic stem cells and neural precusors | | |
| hsa-miR-4260 | 1054 | 2075 | discovered in embryonic stem cells and neural precusors | | |
| hsa-miR-4261 | 1055 | 2076 | discovered in embryonic stem cells and neural precusors | | |
| hsa-miR-4262 | 1056 | 2077 | discovered in embryonic stem cells and neural precusors | | |
| hsa-miR-4263 | 1057 | 2078 | discovered in embryonic stem cells and neural precusors | | |
| hsa-miR-4264 | 1058 | 2079 | discovered in embryonic stem cells and neural precusors | | |
| hsa-miR-4265 | 1059 | 2080 | discovered in embryonic stem cells and neural precusors | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4266 | 1060 | 2081 | discovered in embryonic stem cells and neural precusors | | |
| hsa-miR-4267 | 1061 | 2082 | discovered in embryonic stem cells and neural precusors | | |
| hsa-miR-4268 | 1062 | 2083 | discovered in embryonic stem cells and neural precusors | | |
| hsa-miR-4269 | 1063 | 2084 | discovered in embryonic stem cells and neural precusors | | |
| hsa-miR-4270 | 1064 | 2085 | discovered in embryonic stem cells and neural precusors | | |
| hsa-miR-4271 | 1065 | 2086 | discovered in embryonic stem cells and neural precusors | | |
| hsa-miR-4272 | 1066 | 2087 | discovered in embryonic stem cells and neural precusors | | |
| hsa-miR-4273 | 1067 | 2088 | | | |
| hsa-miR-4274 | 1068 | 2089 | discovered in embryonic stem cells and neural precusors | | |
| hsa-miR-4275 | 1069 | 2090 | discovered in embryonic stem cells and neural precusors | | |
| hsa-miR-4276 | 1070 | 2091 | discovered in embryonic stem cells and neural precusors | | |
| hsa-miR-4277 | 1071 | 2092 | discovered in embryonic stem cells and neural precusors | | |
| hsa-miR-4278 | 1072 | 2093 | discovered in embryonic stem cells and neural precusors | | |
| hsa-miR-4279 | 1073 | 2094 | discovered in embryonic stem cells and neural precusors | | |
| hsa-miR-4280 | 1074 | 2095 | discovered in embryonic stem cells and neural precusors | | |
| hsa-miR-4281 | 1075 | 2096 | discovered in embryonic stem cells and neural precusors | | |
| hsa-miR-4282 | 1076 | 2097 | discovered in embryonic stem cells and neural precusors | | |
| hsa-miR-4283 | 1077 | 2098 | discovered in embryonic stem cells and neural precusors | | |
| hsa-miR-4284 | 1078 | 2099 | discovered in embryonic stem cells and neural precusors | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4285 | 1079 | 2100 | discovered in embryonic stem cells and neural precusors | | |
| hsa-miR-4286 | 1080 | 2101 | discovered in embryonic stem cells and neural precusors | | |
| hsa-miR-4287 | 1081 | 2102 | discovered in embryonic stem cells and neural precusors | | |
| hsa-miR-4288 | 1082 | 2103 | discovered in embryonic stem cells and neural precusors | | |
| hsa-miR-4289 | 1083 | 2104 | discovered in embryonic stem cells and neural precusors | | |
| hsa-miR-429 | 1084 | 2105 | Epithelial cells | various cancers (colorectal, endometrial, gastric, ovarian etc) | |
| hsa-miR-4290 | 1085 | 2106 | discovered in embryonic stem cells and neural precusors | | |
| hsa-miR-4291 | 1086 | 2107 | discovered in embryonic stem cells and neural precusors | | |
| hsa-miR-4292 | 1087 | 2108 | discovered in embryonic stem cells and neural precusors | | |
| hsa-miR-4293 | 1088 | 2109 | discovered in embryonic stem cells and neural precusors | | |
| hsa-miR-4294 | 1089 | 2110 | discovered in embryonic stem cells and neural precusors | | |
| hsa-miR-4295 | 1090 | 2111 | discovered in embryonic stem cells and neural precusors | | |
| hsa-miR-4296 | 1091 | 2112 | discovered in embryonic stem cells and neural precusors | | |
| hsa-miR-4297 | 1092 | 2113 | discovered in embryonic stem cells and neural precusors | | |
| hsa-miR-4298 | 1093 | 2114 | discovered in embryonic stem cells and neural precusors | | |
| hsa-miR-4299 | 1094 | 2115 | discovered in embryonic stem cells and neural precusors | | |
| hsa-miR-4300 | 1095 | 2116 | discovered in embryonic stem cells and neural precusors | | |
| hsa-miR-4301 | 1096 | 2117 | discovered in embryonic stem cells and neural precusors | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4302 | 1097 | 2118 | discovered in embryonic stem cells and neural precusors | | |
| hsa-miR-4303 | 1098 | 2119 | discovered in embryonic stem cells and neural precusors | | |
| hsa-miR-4304 | 1099 | 2120 | discovered in embryonic stem cells and neural precusors | | |
| hsa-miR-4305 | 1100 | 2121 | discovered in embryonic stem cells and neural precusors | | |
| hsa-miR-4306 | 1101 | 2122 | discovered in embryonic stem cells and neural precusors | | |
| hsa-miR-4307 | 1102 | 2123 | discovered in embryonic stem cells and neural precusors | | |
| hsa-miR-4308 | 1103 | 2124 | discovered in embryonic stem cells and neural precusors | | |
| hsa-miR-4309 | 1104 | 2125 | discovered in embryonic stem cells and neural precusors | | |
| hsa-miR-4310 | 1105 | 2126 | discovered in embryonic stem cells and neural precusors | | |
| hsa-miR-4311 | 1106 | 2127 | discovered in embryonic stem cells and neural precusors | | |
| hsa-miR-4312 | 1107 | 2128 | discovered in embryonic stem cells and neural precusors | | |
| hsa-miR-4313 | 1108 | 2129 | discovered in embryonic stem cells and neural precusors | | |
| hsa-miR-431-3p | 1109 | 2130 | | Cancers (follicular lymphoma) | |
| hsa-miR-4314 | 1110 | 2131 | discovered in embryonic stem cells and neural precusors | | |
| hsa-miR-4315 | 1111 | 2132 | discovered in embryonic stem cells and neural precusors | | |
| hsa-miR-431-5p | 1112 | 2133 | | Cancers (follicular lymphoma) | |
| hsa-miR-4316 | 1113 | 2134 | discovered in embryonic stem cells and neural precusors | | |
| hsa-miR-4317 | 1114 | 2135 | discovered in embryonic stem cells and neural precusors | | |
| hsa-miR-4318 | 1115 | 2136 | discovered in embryonic stem cells and neural precusors | | |
| hsa-miR-4319 | 1116 | 2137 | discovered in embryonic stem | | |

TABLE 12-continued mirs, tissues/cell expression and diseases

| microRNA | mir SEQ ID | BS SEQ ID | Tissues/cells | Associated disease | Biological function |
|---|---|---|---|---|---|
| | | | cells and neural precusors | | |
| hsa-miR-4320 | 1117 | 2138 | discovered in embryonic stem cells and neural precusors | | |
| hsa-miR-4321 | 1118 | 2139 | discovered in embryonic stem cells and neural precusors | | |
| hsa-miR-4322 | 1119 | 2140 | discovered in embryonic stem cells and neural precusors | | |
| hsa-miR-4323 | 1120 | 2141 | discovered in embryonic stem cells and neural precusors | | |
| hsa-miR-432-3p | 1121 | 2142 | myoblast | | myogenic differentiation |
| hsa-miR-4324 | 1122 | 2143 | discovered in embryonic stem cells and neural precusors | | |
| hsa-miR-4325 | 1123 | 2144 | discovered in embryonic stem cells and neural precusors | | |
| hsa-miR-432-5p | 1124 | 2145 | myoblast | | myogenic differentiation |
| hsa-miR-4326 | 1125 | 2146 | discovered in embryonic stem cells and neural precusors | | |
| hsa-miR-4327 | 1126 | 2147 | discovered in embryonic stem cells and neural precusors | | |
| hsa-miR-4328 | 1127 | 2148 | discovered in embryonic stem cells and neural precusors | | |
| hsa-miR-4329 | 1128 | 2149 | discovered in embryonic stem cells and neural precusors | | |
| hsa-miR-433 | 1129 | 2150 | | various diseases (cancer, Parkinson's, Chondrodysplasia) | |
| hsa-miR-4330 | 1130 | 2151 | discovered in embryonic stem cells and neural precusors | | |
| hsa-miR-4417 | 1131 | 2152 | discovered in B cells | | |
| hsa-miR-4418 | 1132 | 2153 | discovered in B cells | | |
| hsa-miR-4419a | 1133 | 2154 | discovered in B cells | | |
| hsa-miR-4419b | 1134 | 2155 | discovered in B cells | | |
| hsa-miR-4420 | 1135 | 2156 | discovered in B cells | | |
| hsa-miR-4421 | 1136 | 2157 | discovered in B cells | | |
| hsa-miR-4422 | 1137 | 2158 | discovered in breast tumor and B cells | | |
| hsa-miR-4423-3p | 1138 | 2159 | discovered in breast tumor, B cells and skin(psoriasis) | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4423-5p | 1139 | 2160 | discovered in breast tumor B cells and skin(psoriasis) | | |
| hsa-miR-4424 | 1140 | 2161 | discovered in B cells | | |
| hsa-miR-4425 | 1141 | 2162 | discovered in B cells | | |
| hsa-miR-4426 | 1142 | 2163 | discovered in B cells | | |
| hsa-miR-4427 | 1143 | 2164 | discovered in B cells | | |
| hsa-miR-4428 | 1144 | 2165 | discovered in B cells | | |
| hsa-miR-4429 | 1145 | 2166 | discovered in B cells | | |
| hsa-miR-4430 | 1146 | 2167 | discovered in B cells | | |
| hsa-miR-4431 | 1147 | 2168 | discovered in B cells | | |
| hsa-miR-4432 | 1148 | 2169 | discovered in B cells | | |
| hsa-miR-4433-3p | 1149 | 2170 | discovered in B cells | | |
| hsa-miR-4433-5p | 1150 | 2171 | discovered in B cells | | |
| hsa-miR-4434 | 1151 | 2172 | discovered in B cells | | |
| hsa-miR-4435 | 1152 | 2173 | discovered in B cells | | |
| hsa-miR-4436a | 1153 | 2174 | discovered in breast tumor and B cells | | |
| hsa-miR-4436b-3p | 1154 | 2175 | discovered in breast tumor | | |
| hsa-miR-4436b-5p | 1155 | 2176 | discovered in breast tumor | | |
| hsa-miR-4437 | 1156 | 2177 | discovered in B cells | | |
| hsa-miR-4438 | 1157 | 2178 | discovered in B cells | | |
| hsa-miR-4439 | 1158 | 2179 | discovered in B cells | | |
| hsa-miR-4440 | 1159 | 2180 | discovered in B cells | | |
| hsa-miR-4441 | 1160 | 2181 | discovered in B cells | | |
| hsa-miR-4442 | 1161 | 2182 | discovered in B cells | | |
| hsa-miR-4443 | 1162 | 2183 | discovered in B cells | | |
| hsa-miR-4444 | 1163 | 2184 | discovered in B cells | | |
| hsa-miR-4445-3p | 1164 | 2185 | discovered in B cells | | |
| hsa-miR-4445-5p | 1165 | 2186 | discovered in B cells | | |
| hsa-miR-4446-3p | 1166 | 2187 | discovered in breast tumor and B cells | | |
| hsa-miR-4446-5p | 1167 | 2188 | discovered in breast tumor and B cells | | |
| hsa-miR-4447 | 1168 | 2189 | discovered in B cells | | |
| hsa-miR-4448 | 1169 | 2190 | discovered in B cells | | |
| hsa-miR-4449 | 1170 | 2191 | discovered in B cells | | |
| hsa-miR-4450 | 1171 | 2192 | discovered in B cells | | |
| hsa-miR-4451 | 1172 | 2193 | discovered in B cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4452 | 1173 | 2194 | discovered in B cells | | |
| hsa-miR-4453 | 1174 | 2195 | discovered in B cells | | |
| hsa-miR-4454 | 1175 | 2196 | discovered in B cells | | |
| hsa-miR-4455 | 1176 | 2197 | discovered in B cells | | |
| hsa-miR-4456 | 1177 | 2198 | discovered in B cells | | |
| hsa-miR-4457 | 1178 | 2199 | discovered in B cells | | |
| hsa-miR-4458 | 1179 | 2200 | discovered in B cells | | |
| hsa-miR-4459 | 1180 | 2201 | discovered in B cells | | |
| hsa-miR-4460 | 1181 | 2202 | discovered in B cells | | |
| hsa-miR-4461 | 1182 | 2203 | discovered in B cells | | |
| hsa-miR-4462 | 1183 | 2204 | discovered in B cells | | |
| hsa-miR-4463 | 1184 | 2205 | discovered in B cells | | |
| hsa-miR-4464 | 1185 | 2206 | discovered in B cells | | |
| hsa-miR-4465 | 1186 | 2207 | discovered in B cells | | |
| hsa-miR-4466 | 1187 | 2208 | discovered in B cells | | |
| hsa-miR-4467 | 1188 | 2209 | discovered in breast tumor and B cells | | |
| hsa-miR-4468 | 1189 | 2210 | discovered in B cells | | |
| hsa-miR-4469 | 1190 | 2211 | discovered in breast tumor and B cells | | |
| hsa-miR-4470 | 1191 | 2212 | discovered in B cells | | |
| hsa-miR-4471 | 2213 | 3234 | discovered in breast tumor and B cells | | |
| hsa-miR-4472 | 2214 | 3235 | discovered in B cells | | |
| hsa-miR-4473 | 2215 | 3236 | discovered in B cells | | |
| hsa-miR-4474-3p | 2216 | 3237 | discovered in breast tumor, lymphoblastic leukaemia and B cells | | |
| hsa-miR-4474-5p | 2217 | 3238 | discovered in breast tumor, lymphoblastic leukaemia and B cells | | |
| hsa-miR-4475 | 2218 | 3239 | discovered in B cells | | |
| hsa-miR-4476 | 2219 | 3240 | discovered in B cells | | |
| hsa-miR-4477a | 2220 | 3241 | discovered in B cells | | |
| hsa-miR-4477b | 2221 | 3242 | discovered in B cells | | |
| hsa-miR-4478 | 2222 | 3243 | discovered in B cells | | |
| hsa-miR-4479 | 2223 | 3244 | discovered in B cells | | |
| hsa-miR-448 | 2224 | 3245 | liver(hepatocytes) | HCC | |
| hsa-miR-4480 | 2225 | 3246 | discovered in B cells | | |
| hsa-miR-4481 | 2226 | 3247 | discovered in B cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4482-3p | 2227 | 3248 | discovered in B cells | | |
| hsa-miR-4482-5p | 2228 | 3249 | discovered in B cells | | |
| hsa-miR-4483 | 2229 | 3250 | discovered in B cells | | |
| hsa-miR-4484 | 2230 | 3251 | discovered in B cells | | |
| hsa-miR-4485 | 2231 | 3252 | discovered in B cells | | |
| hsa-miR-4486 | 2232 | 3253 | discovered in B cells | | |
| hsa-miR-4487 | 2233 | 3254 | discovered in B cells | | |
| hsa-miR-4488 | 2234 | 3255 | discovered in B cells | | |
| hsa-miR-4489 | 2235 | 3256 | discovered in breast tumor and B cells | | |
| hsa-miR-4490 | 2236 | 3257 | discovered in B cells | | |
| hsa-miR-4491 | 2237 | 3258 | discovered in B cells | | |
| hsa-miR-4492 | 2238 | 3259 | discovered in B cells | | |
| hsa-miR-4493 | 2239 | 3260 | discovered in B cells | | |
| hsa-miR-4494 | 2240 | 3261 | discovered in B cells | | |
| hsa-miR-4495 | 2241 | 3262 | discovered in B cells | | |
| hsa-miR-4496 | 2242 | 3263 | discovered in B cells | | |
| hsa-miR-4497 | 2243 | 3264 | discovered in B cells | | |
| hsa-miR-4498 | 2244 | 3265 | discovered in B cells | | |
| hsa-miR-4499 | 2245 | 3266 | discovered in B cells | | |
| hsa-miR-449a | 2246 | 3267 | chondrocytes, ciliated epithelial cells | lung, colonic, ovarian cancer | cell cycle progression and proliferation |
| hsa-miR-449b-3p | 2247 | 3268 | ciliated epithelial cells, other tissues | various cancer cells | cell cycle progression and proliferation |
| hsa-miR-449b-5p | 2248 | 3269 | ciliated epithelial cells, other tissues | various cancer cells | cell cycle progression and proliferation |
| hsa-miR-449c-3p | 2249 | 3270 | | epithelial ovarian cancer cells | |
| hsa-miR-449c-5p | 2250 | 3271 | | epithelial ovarian cancer cells | |
| hsa-miR-4500 | 2251 | 3272 | discovered in B cells | | |
| hsa-miR-4501 | 2252 | 3273 | discovered in B cells | | |
| hsa-miR-4502 | 2253 | 3274 | discovered in B cells | | |
| hsa-miR-4503 | 2254 | 3275 | discovered in B cells | | |
| hsa-miR-4504 | 2255 | 3276 | discovered in B cells | | |
| hsa-miR-4505 | 2256 | 3277 | discovered in B cells | | |
| hsa-miR-4506 | 2257 | 3278 | discovered in B cells | | |
| hsa-miR-4507 | 2258 | 3279 | discovered in B cells | | |
| hsa-miR-4508 | 2259 | 3280 | discovered in B cells | | |
| hsa-miR-4509 | 2260 | 3281 | discovered in B cells | | |
| hsa-miR-450a-3p | 2261 | 3282 | | | |
| hsa-miR-450a-5p | 2262 | 3283 | | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-450b-3p | 2263 | 3284 | | | |
| hsa-miR-450b-5p | 2264 | 3285 | | | |
| hsa-miR-4510 | 2265 | 3286 | discovered in B cells | | |
| hsa-miR-4511 | 2266 | 3287 | discovered in B cells | | |
| hsa-miR-4512 | 2267 | 3288 | discovered in B cells | | |
| hsa-miR-4513 | 2268 | 3289 | discovered in B cells | | |
| hsa-miR-4514 | 2269 | 3290 | discovered in B cells | | |
| hsa-miR-4515 | 2270 | 3291 | discovered in B cells | | |
| hsa-miR-4516 | 2271 | 3292 | discovered in B cells | | |
| hsa-miR-4517 | 2272 | 3293 | discovered in B cells | | |
| hsa-miR-4518 | 2273 | 3294 | discovered in B cells | | |
| hsa-miR-4519 | 2274 | 3295 | discovered in B cells | | |
| hsa-miR-451a | 2275 | 3296 | heart, central nevous system, epithelial cells | | |
| hsa-miR-451b | 2276 | 3297 | heart, central nevous system, epithelial cells | | |
| hsa-miR-4520a-3p | 2277 | 3298 | discovered in breast tumor and B cells, skin(psoriasis) | | |
| hsa-miR-4520a-5p | 2278 | 3299 | discovered in breast tumor and B cells, skin(psoriasis) | | |
| hsa-miR-4520b-3p | 2279 | 3300 | discovered in breast tumor | | |
| hsa-miR-4520b-5p | 2280 | 3301 | discovered in breast tumor | | |
| hsa-miR-4521 | 2281 | 3302 | discovered in B cells | | |
| hsa-miR-4522 | 2282 | 3303 | discovered in B cells | | |
| hsa-miR-4523 | 2283 | 3304 | discovered in B cells | | |
| hsa-miR-452-3p | 2284 | 3305 | myoblast | bladder cancer and others | |
| hsa-miR-4524a-3p | 2285 | 3306 | discovered in breast tumor and B cells, skin(psoriasis) | | |
| hsa-miR-4524a-5p | 2286 | 3307 | discovered in breast tumor and B cells, skin(psoriasis) | | |
| hsa-miR-4524b-3p | 2287 | 3308 | discovered in breast tumor and B cells, skin(psoriasis) | | |
| hsa-miR-4524b-5p | 2288 | 3309 | discovered in breast tumor and B cells, skin(psoriasis) | | |
| hsa-miR-4525 | 2289 | 3310 | discovered in B cells | | |
| hsa-miR-452-5p | 2290 | 3311 | myoblast | bladder cancer and others | |
| hsa-miR-4526 | 2291 | 3312 | discovered in breast tumor and B cells | | |
| hsa-miR-4527 | 2292 | 3313 | discovered in B cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4528 | 2293 | 3314 | discovered in B cells | | |
| hsa-miR-4529-3p | 2294 | 3315 | discovered in breast tumor and B cells | | |
| hsa-miR-4529-5p | 2295 | 3316 | discovered in breast tumor and B cells | | |
| hsa-miR-4530 | 2296 | 3317 | discovered in B cells | | |
| hsa-miR-4531 | 2297 | 3318 | discovered in B cells | | |
| hsa-miR-4532 | 2298 | 3319 | discovered in B cells | | |
| hsa-miR-4533 | 2299 | 3320 | discovered in B cells | | |
| hsa-miR-4534 | 2300 | 3321 | discovered in B cells | | |
| hsa-miR-4535 | 2301 | 3322 | discovered in B cells | | |
| hsa-miR-4536-3p | 2302 | 3323 | discovered in B cells | | |
| hsa-miR-4536-5p | 2303 | 3324 | discovered in B cells | | |
| hsa-miR-4537 | 2304 | 3325 | discovered in B cells | | |
| hsa-miR-4538 | 2305 | 3326 | discovered in B cells | | |
| hsa-miR-4539 | 2306 | 3327 | discovered in B cells | | |
| hsa-miR-4540 | 2307 | 3328 | discovered in B cells | | |
| hsa-miR-454-3p | 2308 | 3329 | embryoid body cells, central nevous system, monocytes | | |
| hsa-miR-454-5p | 2309 | 3330 | embryoid body cells, central nevous system, monocytes | | |
| hsa-miR-455-3p | 2310 | 3331 | | basal cell carcinoma, other cancers | |
| hsa-miR-455-5p | 2311 | 3332 | | basal cell carcinoma, other cancers | |
| hsa-miR-4632-3p | 2312 | 3333 | discovred in breast tumor | | |
| hsa-miR-4632-5p | 2313 | 3334 | discovered in breast tumor | | |
| hsa-miR-4633-3p | 2314 | 3335 | discovered in breast tumor | | |
| hsa-miR-4633-5p | 2315 | 3336 | discovered in breast tumor | | |
| hsa-miR-4634 | 2316 | 3337 | discovered in breast tumor | | |
| hsa-miR-4635 | 2317 | 3338 | discovered in breast tumor | | |
| hsa-miR-4636 | 2318 | 3339 | discovered in breast tumor | | |
| hsa-miR-4637 | 2319 | 3340 | discovered in breast tumor and lymphoblastic leukaemia | | |
| hsa-miR-4638-3p | 2320 | 3341 | discovered in breast tumor | | |
| hsa-miR-4638-5p | 2321 | 3342 | discovered in breast tumor | | |
| hsa-miR-4639-3p | 2322 | 3343 | discovered in breast tumor | | |
| hsa-miR-4639-5p | 2323 | 3344 | discovered in breast tumor | | |
| hsa-miR-4640-3p | 2324 | 3345 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4640-5p | 2325 | 3346 | discovered in breast tumor | | |
| hsa-miR-4641 | 2326 | 3347 | discovered in breast tumor | | |
| hsa-miR-4642 | 2327 | 3348 | discovered in breast tumor | | |
| hsa-miR-4643 | 2328 | 3349 | discovered in breast tumor | | |
| hsa-miR-4644 | 2329 | 3350 | discovered in breast tumor | | |
| hsa-miR-4645-3p | 2330 | 3351 | discovered in breast tumor | | |
| hsa-miR-4645-5p | 2331 | 3352 | discovered in breast tumor | | |
| hsa-miR-4646-3p | 2332 | 3353 | discovered in breast tumor | | |
| hsa-miR-4646-5p | 2333 | 3354 | discovered in breast tumor | | |
| hsa-miR-4647 | 2334 | 3355 | discovered in breast tumor | | |
| hsa-miR-4648 | 2335 | 3356 | discovered in breast tumor | | |
| hsa-miR-4649-3p | 2336 | 3357 | discovered in breast tumor | | |
| hsa-miR-4649-5p | 2337 | 3358 | discovered in breast tumor | | |
| hsa-miR-4650-3p | 2338 | 3359 | discovered in breast tumor | | |
| hsa-miR-4650-5p | 2339 | 3360 | discovered in breast tumor | | |
| hsa-miR-4651 | 2340 | 3361 | discovered in breast tumor | | |
| hsa-miR-4652-3p | 2341 | 3362 | discovered in breast tumor | | |
| hsa-miR-4652-5p | 2342 | 3363 | discovered in breast tumor | | |
| hsa-miR-4653-3p | 2343 | 3364 | discovered in breast tumor | | |
| hsa-miR-4653-5p | 2344 | 3365 | discovered in breast tumor | | |
| hsa-miR-4654 | 2345 | 3366 | discovered in breast tumor | | |
| hsa-miR-4655-3p | 2346 | 3367 | discovered in breast tumor | | |
| hsa-miR-4655-5p | 2347 | 3368 | discovered in breast tumor | | |
| hsa-miR-4656 | 2348 | 3369 | discovered in breast tumor | | |
| hsa-miR-4657 | 2349 | 3370 | discovered in breast tumor | | |
| hsa-miR-4658 | 2350 | 3371 | discovered in breast tumor | | |
| hsa-miR-4659a-3p | 2351 | 3372 | discovered in breast tumor | | |
| hsa-miR-4659a-5p | 2352 | 3373 | discovered in breast tumor | | |
| hsa-miR-4659b-3p | 2353 | 3374 | discovered in breast tumor | | |
| hsa-miR-4659b-5p | 2354 | 3375 | discovered in breast tumor | | |
| hsa-miR-466 | 2355 | 3376 | | | |
| hsa-miR-4660 | 2356 | 3377 | discovered in breast tumor | | |
| hsa-miR-4661-3p | 2357 | 3378 | discovered in breast tumor | | |
| hsa-miR-4661-5p | 2358 | 3379 | discovered in breast tumor | | |
| hsa-miR-4662a-3p | 2359 | 3380 | discovered in breast tumor, psoriasis | | |
| hsa-miR-4662a-5p | 2360 | 3381 | discovered in breast tumor, psoriasis | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4662b | 2361 | 3382 | discovered in breast tumor | | |
| hsa-miR-4663 | 2362 | 3383 | discovered in breast tumor | | |
| hsa-miR-4664-3p | 2363 | 3384 | discovered in breast tumor | | |
| hsa-miR-4664-5p | 2364 | 3385 | discovered in breast tumor | | |
| hsa-miR-4665-3p | 2365 | 3386 | discovered in breast tumor | | |
| hsa-miR-4665-5p | 2366 | 3387 | discovered in breast tumor | | |
| hsa-miR-4666a-3p | 2367 | 3388 | discovered in breast tumor | | |
| hsa-miR-4666a-5p | 2368 | 3389 | discovered in breast tumor | | |
| hsa-miR-4666b | 2369 | 3390 | | | |
| hsa-miR-4667-3p | 2370 | 3391 | discovered in breast tumor | | |
| hsa-miR-4667-5p | 2371 | 3392 | discovered in breast tumor | | |
| hsa-miR-4668-3p | 2372 | 3393 | discovered in breast tumor | | |
| hsa-miR-4668-5p | 2373 | 3394 | discovered in breast tumor | | |
| hsa-miR-4669 | 2374 | 3395 | discovered in breast tumor | | |
| hsa-miR-4670-3p | 2375 | 3396 | discovered in breast tumor | | |
| hsa-miR-4670-5p | 2376 | 3397 | discovered in breast tumor | | |
| hsa-miR-4671-3p | 2377 | 3398 | discovered in breast tumor | | |
| hsa-miR-4671-5p | 2378 | 3399 | discovered in breast tumor | | |
| hsa-miR-4672 | 2379 | 3400 | discovered in breast tumor | | |
| hsa-miR-4673 | 2380 | 3401 | discovered in breast tumor | | |
| hsa-miR-4674 | 2381 | 3402 | discovered in breast tumor | | |
| hsa-miR-4675 | 2382 | 3403 | discovered in breast tumor | | |
| hsa-miR-4676-3p | 2383 | 3404 | discovered in breast tumor | | |
| hsa-miR-4676-5p | 2384 | 3405 | discovered in breast tumor | | |
| hsa-miR-4677-3p | 2385 | 3406 | discovered in breast tumor, psoriasis | | |
| hsa-miR-4677-5p | 2386 | 3407 | discovered in breast tumor, psoriasis | | |
| hsa-miR-4678 | 2387 | 3408 | discovered in breast tumor | | |
| hsa-miR-4679 | 2388 | 3409 | discovered in breast tumor | | |
| hsa-miR-4680-3p | 2389 | 3410 | discovered in breast tumor | | |
| hsa-miR-4680-5p | 2390 | 3411 | discovered in breast tumor | | |
| hsa-miR-4681 | 2391 | 3412 | discovered in breast tumor | | |
| hsa-miR-4682 | 2392 | 3413 | discovered in breast tumor | | |
| hsa-miR-4683 | 2393 | 3414 | discovered in breast tumor | | |
| hsa-miR-4684-3p | 2394 | 3415 | discovered in breast tumor | | |
| hsa-miR-4684-5p | 2395 | 3416 | discovered in breast tumor | | |
| hsa-miR-4685-3p | 2396 | 3417 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4685-5p | 2397 | 3418 | discovered in breast tumor | | |
| hsa-miR-4686 | 2398 | 3419 | discovered in breast tumor | | |
| hsa-miR-4687-3p | 2399 | 3420 | discovered in breast tumor | | |
| hsa-miR-4687-5p | 2400 | 3421 | discovered in breast tumor | | |
| hsa-miR-4688 | 2401 | 3422 | discovered in breast tumor | | |
| hsa-miR-4689 | 2402 | 3423 | discovered in breast tumor | | |
| hsa-miR-4690-3p | 2403 | 3424 | discovered in breast tumor | | |
| hsa-miR-4690-5p | 2404 | 3425 | discovered in breast tumor | | |
| hsa-miR-4691-3p | 2405 | 3426 | discovered in breast tumor | | |
| hsa-miR-4691-5p | 2406 | 3427 | discovered in breast tumor | | |
| hsa-miR-4692 | 2407 | 3428 | discovered in breast tumor | | |
| hsa-miR-4693-3p | 2408 | 3429 | discovered in breast tumor | | |
| hsa-miR-4693-5p | 2409 | 3430 | discovered in breast tumor | | |
| hsa-miR-4694-3p | 2410 | 3431 | discovered in breast tumor | | |
| hsa-miR-4694-5p | 2411 | 3432 | discovered in breast tumor | | |
| hsa-miR-4695-3p | 2412 | 3433 | discovered in breast tumor | | |
| hsa-miR-4695-5p | 2413 | 3434 | discovered in breast tumor | | |
| hsa-miR-4696 | 2414 | 3435 | discovered in breast tumor | | |
| hsa-miR-4697-3p | 2415 | 3436 | discovered in breast tumor | | |
| hsa-miR-4697-5p | 2416 | 3437 | discovered in breast tumor | | |
| hsa-miR-4698 | 2417 | 3438 | discovered in breast tumor | | |
| hsa-miR-4699-3p | 2418 | 3439 | discovered in breast tumor | | |
| hsa-miR-4699-5p | 2419 | 3440 | discovered in breast tumor | | |
| hsa-miR-4700-3p | 2420 | 3441 | discovered in breast tumor | | |
| hsa-miR-4700-5p | 2421 | 3442 | discovered in breast tumor | | |
| hsa-miR-4701-3p | 2422 | 3443 | discovered in breast tumor | | |
| hsa-miR-4701-5p | 2423 | 3444 | discovered in breast tumor | | |
| hsa-miR-4703-3p | 2424 | 3445 | discovered in breast tumor | | |
| hsa-miR-4703-5p | 2425 | 3446 | discovered in breast tumor | | |
| hsa-miR-4704-3p | 2426 | 3447 | discovered in breast tumor | | |
| hsa-miR-4704-5p | 2427 | 3448 | discovered in breast tumor | | |
| hsa-miR-4705 | 2428 | 3449 | discovered in breast tumor | | |
| hsa-miR-4706 | 2429 | 3450 | discovered in breast tumor | | |
| hsa-miR-4707-3p | 2430 | 3451 | discovered in breast tumor | | |
| hsa-miR-4707-5p | 2431 | 3452 | discovered in breast tumor | | |
| hsa-miR-4708-3p | 2432 | 3453 | discovered in breast tumor | | |
| hsa-miR-4708-5p | 2433 | 3454 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4709-3p | 2434 | 3455 | discovered in breast tumor | | |
| hsa-miR-4709-5p | 2435 | 3456 | discovered in breast tumor | | |
| hsa-miR-4710 | 2436 | 3457 | discovered in breast tumor | | |
| hsa-miR-4711-3p | 2437 | 3458 | discovered in breast tumor | | |
| hsa-miR-4711-5p | 2438 | 3459 | discovered in breast tumor | | |
| hsa-miR-4712-3p | 2439 | 3460 | discovered in breast tumor | | |
| hsa-miR-4712-5p | 2440 | 3461 | discovered in breast tumor | | |
| hsa-miR-4713-3p | 2441 | 3462 | discovered in breast tumor | | |
| hsa-miR-4713-5p | 2442 | 3463 | discovered in breast tumor | | |
| hsa-miR-4714-3p | 2443 | 3464 | discovered in breast tumor | | |
| hsa-miR-4714-5p | 2444 | 3465 | discovered in breast tumor | | |
| hsa-miR-4715-3p | 2445 | 3466 | discovered in breast tumor | | |
| hsa-miR-4715-5p | 2446 | 3467 | discovered in breast tumor | | |
| hsa-miR-4716-3p | 2447 | 3468 | discovered in breast tumor | | |
| hsa-miR-4716-5p | 2448 | 3469 | discovered in breast tumor | | |
| hsa-miR-4717-3p | 2449 | 3470 | discovered in breast tumor | | |
| hsa-miR-4717-5p | 2450 | 3471 | discovered in breast tumor | | |
| hsa-miR-4718 | 2451 | 3472 | discovered in breast tumor | | |
| hsa-miR-4719 | 2452 | 3473 | discovered in breast tumor | | |
| hsa-miR-4720-3p | 2453 | 3474 | discovered in breast tumor | | |
| hsa-miR-4720-5p | 2454 | 3475 | discovered in breast tumor | | |
| hsa-miR-4721 | 2455 | 3476 | discovered in breast tumor | | |
| hsa-miR-4722-3p | 2456 | 3477 | discovered in breast tumor | | |
| hsa-miR-4722-5p | 2457 | 3478 | discovered in breast tumor | | |
| hsa-miR-4723-3p | 2458 | 3479 | discovered in breast tumor | | |
| hsa-miR-4723-5p | 2459 | 3480 | discovered in breast tumor | | |
| hsa-miR-4724-3p | 2460 | 3481 | discovered in breast tumor | | |
| hsa-miR-4724-5p | 2461 | 3482 | discovered in breast tumor | | |
| hsa-miR-4725-3p | 2462 | 3483 | discovered in breast tumor | | |
| hsa-miR-4725-5p | 2463 | 3484 | discovered in breast tumor | | |
| hsa-miR-4726-3p | 2464 | 3485 | discovered in breast tumor | | |
| hsa-miR-4726-5p | 2465 | 3486 | discovered in breast tumor | | |
| hsa-miR-4727-3p | 2466 | 3487 | discovered in breast tumor | | |
| hsa-miR-4727-5p | 2467 | 3488 | discovered in breast tumor | | |
| hsa-miR-4728-3p | 2468 | 3489 | discovered in breast tumor | | |
| hsa-miR-4728-5p | 2469 | 3490 | discovered in breast tumor | | |
| hsa-miR-4729 | 2470 | 3491 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4730 | 2471 | 3492 | discovered in breast tumor | | |
| hsa-miR-4731-3p | 2472 | 3493 | discovered in breast tumor | | |
| hsa-miR-4731-5p | 2473 | 3494 | discovered in breast tumor | | |
| hsa-miR-4732-3p | 2474 | 3495 | discovered in breast tumor | | |
| hsa-miR-4732-5p | 2475 | 3496 | discovered in breast tumor | | |
| hsa-miR-4733-3p | 2476 | 3497 | discovered in breast tumor | | |
| hsa-miR-4733-5p | 2477 | 3498 | discovered in breast tumor | | |
| hsa-miR-4734 | 2478 | 3499 | discovered in breast tumor | | |
| hsa-miR-4735-3p | 2479 | 3500 | discovered in breast tumor | | |
| hsa-miR-4735-5p | 2480 | 3501 | discovered in breast tumor | | |
| hsa-miR-4736 | 2481 | 3502 | discovered in breast tumor | | |
| hsa-miR-4737 | 2482 | 3503 | discovered in breast tumor | | |
| hsa-miR-4738-3p | 2483 | 3504 | discovered in breast tumor | | |
| hsa-miR-4738-5p | 2484 | 3505 | discovered in breast tumor | | |
| hsa-miR-4739 | 2485 | 3506 | discovered in breast tumor | | |
| hsa-miR-4740-3p | 2486 | 3507 | discovered in breast tumor | | |
| hsa-miR-4740-5p | 2487 | 3508 | discovered in breast tumor | | |
| hsa-miR-4741 | 2488 | 3509 | discovered in breast tumor, psoriasis | | |
| hsa-miR-4742-3p | 2489 | 3510 | discovered in breast tumor, psoriasis | | |
| hsa-miR-4742-5p | 2490 | 3511 | discovered in breast tumor | | |
| hsa-miR-4743-3p | 2491 | 3512 | discovered in breast tumor | | |
| hsa-miR-4743-5p | 2492 | 3513 | discovered in breast tumor | | |
| hsa-miR-4744 | 2493 | 3514 | discovered in breast tumor | | |
| hsa-miR-4745-3p | 2494 | 3515 | discovered in breast tumor | | |
| hsa-miR-4745-5p | 2495 | 3516 | discovered in breast tumor | | |
| hsa-miR-4746-3p | 2496 | 3517 | discovered in breast tumor | | |
| hsa-miR-4746-5p | 2497 | 3518 | discovered in breast tumor | | |
| hsa-miR-4747-3p | 2498 | 3519 | discovered in breast tumor | | |
| hsa-miR-4747-5p | 2499 | 3520 | discovered in breast tumor | | |
| hsa-miR-4748 | 2500 | 3521 | discovered in breast tumor | | |
| hsa-miR-4749-3p | 2501 | 3522 | discovered in breast tumor | | |
| hsa-miR-4749-5p | 2502 | 3523 | discovered in breast tumor | | |
| hsa-miR-4750-3p | 2503 | 3524 | discovered in breast tumor | | |
| hsa-miR-4750-5p | 2504 | 3525 | discovered in breast tumor | | |
| hsa-miR-4751 | 2505 | 3526 | discovered in breast tumor | | |
| hsa-miR-4752 | 2506 | 3527 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4753-3p | 2507 | 3528 | discovered in breast tumor | | |
| hsa-miR-4753-5p | 2508 | 3529 | discovered in breast tumor | | |
| hsa-miR-4754 | 2509 | 3530 | discovered in breast tumor | | |
| hsa-miR-4755-3p | 2510 | 3531 | discovered in breast tumor | | |
| hsa-miR-4755-5p | 2511 | 3532 | discovered in breast tumor | | |
| hsa-miR-4756-3p | 2512 | 3533 | discovered in breast tumor | | |
| hsa-miR-4756-5p | 2513 | 3534 | discovered in breast tumor | | |
| hsa-miR-4757-3p | 2514 | 3535 | discovered in breast tumor | | |
| hsa-miR-4757-5p | 2515 | 3536 | discovered in breast tumor | | |
| hsa-miR-4758-3p | 2516 | 3537 | discovered in breast tumor | | |
| hsa-miR-4758-5p | 2517 | 3538 | discovered in breast tumor | | |
| hsa-miR-4759 | 2518 | 3539 | discovered in breast tumor | | |
| hsa-miR-4760-3p | 2519 | 3540 | discovered in breast tumor | | |
| hsa-miR-4760-5p | 2520 | 3541 | discovered in breast tumor | | |
| hsa-miR-4761-3p | 2521 | 3542 | discovered in breast tumor | | |
| hsa-miR-4761-5p | 2522 | 3543 | discovered in breast tumor | | |
| hsa-miR-4762-3p | 2523 | 3544 | discovered in breast tumor | | |
| hsa-miR-4762-5p | 2524 | 3545 | discovered in breast tumor | | |
| hsa-miR-4763-3p | 2525 | 3546 | discovered in breast tumor | | |
| hsa-miR-4763-5p | 2526 | 3547 | discovered in breast tumor | | |
| hsa-miR-4764-3p | 2527 | 3548 | discovered in breast tumor | | |
| hsa-miR-4764-5p | 2528 | 3549 | discovered in breast tumor | | |
| hsa-miR-4765 | 2529 | 3550 | discovered in breast tumor | | |
| hsa-miR-4766-3p | 2530 | 3551 | discovered in breast tumor | | |
| hsa-miR-4766-5p | 2531 | 3552 | discovered in breast tumor | | |
| hsa-miR-4767 | 2532 | 3553 | discovered in breast tumor | | |
| hsa-miR-4768-3p | 2533 | 3554 | discovered in breast tumor | | |
| hsa-miR-4768-5p | 2534 | 3555 | discovered in breast tumor | | |
| hsa-miR-4769-3p | 2535 | 3556 | discovered in breast tumor | | |
| hsa-miR-4769-5p | 2536 | 3557 | discovered in breast tumor | | |
| hsa-miR-4770 | 2537 | 3558 | discovered in breast tumor | | |
| hsa-miR-4771 | 2538 | 3559 | discovered in breast tumor | | |
| hsa-miR-4772-3p | 2539 | 3560 | discovered in breast tumor, blood monoclear cells | energy metabolism/ obesity | |
| hsa-miR-4772-5p | 2540 | 3561 | discovered in breast tumor, blood monoclear cells | energy metabolism/ obesity | |
| hsa-miR-4773 | 2541 | 3562 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4774-3p | 2542 | 3563 | discovered in breast tumor and Lymphoblastic leukemia | | |
| hsa-miR-4774-5p | 2543 | 3564 | discovered in breast tumor and Lymphoblastic leukemia | | |
| hsa-miR-4775 | 2544 | 3565 | discovered in breast tumor | | |
| hsa-miR-4776-3p | 2545 | 3566 | discovered in breast tumor | | |
| hsa-miR-4776-5p | 2546 | 3567 | discovered in breast tumor | | |
| hsa-miR-4777-3p | 2547 | 3568 | discovered in breast tumor | | |
| hsa-miR-4777-5p | 2548 | 3569 | discovered in breast tumor | | |
| hsa-miR-4778-3p | 2549 | 3570 | discovered in breast tumor | | |
| hsa-miR-4778-5p | 2550 | 3571 | discovered in breast tumor | | |
| hsa-miR-4779 | 2551 | 3572 | discovered in breast tumor | | |
| hsa-miR-4780 | 2552 | 3573 | discovered in breast tumor | | |
| hsa-miR-4781-3p | 2553 | 3574 | discovered in breast tumor | | |
| hsa-miR-4781-5p | 2554 | 3575 | discovered in breast tumor | | |
| hsa-miR-4782-3p | 2555 | 3576 | discovered in breast tumor | | |
| hsa-miR-4782-5p | 2556 | 3577 | discovered in breast tumor | | |
| hsa-miR-4783-3p | 2557 | 3578 | discovered in breast tumor | | |
| hsa-miR-4783-5p | 2558 | 3579 | discovered in breast tumor | | |
| hsa-miR-4784 | 2559 | 3580 | discovered in breast tumor | | |
| hsa-miR-4785 | 2560 | 3581 | discovered in breast tumor | | |
| hsa-miR-4786-3p | 2561 | 3582 | discovered in breast tumor | | |
| hsa-miR-4786-5p | 2562 | 3583 | discovered in breast tumor | | |
| hsa-miR-4787-3p | 2563 | 3584 | discovered in breast tumor | | |
| hsa-miR-4787-5p | 2564 | 3585 | discovered in breast tumor | | |
| hsa-miR-4788 | 2565 | 3586 | discovered in breast tumor | | |
| hsa-miR-4789-3p | 2566 | 3587 | discovered in breast tumor | | |
| hsa-miR-4789-5p | 2567 | 3588 | discovered in breast tumor | | |
| hsa-miR-4790-3p | 2568 | 3589 | discovered in breast tumor | | |
| hsa-miR-4790-5p | 2569 | 3590 | discovered in breast tumor | | |
| hsa-miR-4791 | 2570 | 3591 | discovered in breast tumor | | |
| hsa-miR-4792 | 2571 | 3592 | discovered in breast tumor | | |
| hsa-miR-4793-3p | 2572 | 3593 | discovered in breast tumor | | |
| hsa-miR-4793-5p | 2573 | 3594 | discovered in breast tumor | | |
| hsa-miR-4794 | 2574 | 3595 | discovered in breast tumor | | |
| hsa-miR-4795-3p | 2575 | 3596 | discovered in breast tumor | | |
| hsa-miR-4795-5p | 2576 | 3597 | discovered in breast tumor | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-4796-3p | 2577 | 3598 | discovered in breast tumor | | |
| hsa-miR-4796-5p | 2578 | 3599 | discovered in breast tumor | | |
| hsa-miR-4797-3p | 2579 | 3600 | discovered in breast tumor | | |
| hsa-miR-4797-5p | 2580 | 3601 | discovered in breast tumor | | |
| hsa-miR-4798-3p | 2581 | 3602 | discovered in breast tumor | | |
| hsa-miR-4798-5p | 2582 | 3603 | discovered in breast tumor | | |
| hsa-miR-4799-3p | 2583 | 3604 | discovered in breast tumor | | |
| hsa-miR-4799-5p | 2584 | 3605 | discovered in breast tumor | | |
| hsa-miR-4800-3p | 2585 | 3606 | discovered in breast tumor | | |
| hsa-miR-4800-5p | 2586 | 3607 | discovered in breast tumor | | |
| hsa-miR-4801 | 2587 | 3608 | discovered in breast tumor | | |
| hsa-miR-4802-3p | 2588 | 3609 | discovered in breast tumor, psoriasis | | |
| hsa-miR-4802-5p | 2589 | 3610 | discovered in breast tumor, psoriasis | | |
| hsa-miR-4803 | 2590 | 3611 | discovered in breast tumor | | |
| hsa-miR-4804-3p | 2591 | 3612 | discovered in breast tumor | | |
| hsa-miR-4804-5p | 2592 | 3613 | discovered in breast tumor | | |
| hsa-miR-483-3p | 2593 | 3614 | | aderonocortical carcinoma, rectal/pancreatic cancer, proliferation of wounded epithelial cells | oncogenic |
| hsa-miR-483-5p | 2594 | 3615 | cartilage (chondrocyte), fetal brain | aderonocortical carcinoma | angiogenesis |
| hsa-miR-484 | 2595 | 3616 | | | mitochondrial network |
| hsa-miR-485-3p | 2596 | 3617 | | | |
| hsa-miR-485-5p | 2597 | 3618 | | ovarian epithelial tumor | |
| hsa-miR-486-3p | 2598 | 3619 | erythroid cells | various cancers | |
| hsa-miR-486-5p | 2599 | 3620 | stem cells (adipose) | various cancers | |
| hsa-miR-487a | 2600 | 3621 | | laryngeal carcinoma | |
| hsa-miR-487b | 2601 | 3622 | | neuroblastoma, pulmonary carcinogenesis | |
| hsa-miR-488-3p | 2602 | 3623 | | prostate cancer, others | |
| hsa-miR-488-5p | 2603 | 3624 | | prostate cancer, others | |
| hsa-miR-489 | 2604 | 3625 | mesenchymal stem cells | osteogenesis | |
| hsa-miR-490-3p | 2605 | 3626 | | neuroblastoma, terine leiomyoma (ULM)/muscle | |
| hsa-miR-490-5p | 2606 | 3627 | | neuroblastoma, terine leiomyoma (ULM)/muscle | |
| hsa-miR-491-3p | 2607 | 3628 | | various cancers, brain disease | pro-apoptosis |
| hsa-miR-491-5p | 2608 | 3629 | | various cancers, brain disease | pro-apoptosis |
| hsa-miR-492 | 2609 | 3630 | | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-493-3p | 2610 | 3631 | myeloid cells, pancreas (islet) | | |
| hsa-miR-493-5p | 2611 | 3632 | myeloid cells, pancreas (islet) | | |
| hsa-miR-494 | 2612 | 3633 | epithelial cells | various cancers | cell cycle |
| hsa-miR-495-3p | 2613 | 3634 | platelet | various cancers (gastric, MLL leukemia, pancreatic etc) and inflammation | |
| hsa-miR-495-5p | 2614 | 3635 | platelet | various cancers (gastric, MLL leukemia, pancreatic etc) and inflammation | |
| hsa-miR-496 | 2615 | 3636 | Blood | | |
| hsa-miR-497-3p | 2616 | 3637 | | various cancers (breast, colorectal, etc) | tumor supressor/pro-apoptosis |
| hsa-miR-497-5p | 2617 | 3638 | | various cancers (breast, colorectal, etc) | tumor supressor/pro-apoptosis |
| hsa-miR-498 | 2618 | 3639 | | autoimmuno (e.g. rheumatoid arthritis) | |
| hsa-miR-4999-3p | 2619 | 3640 | | | |
| hsa-miR-4999-5p | 2620 | 3641 | | | |
| hsa-miR-499a-3p | 2621 | 3642 | heart, cardiac stem cells | cardiovascular disease | cardiomyocyte differentiation |
| hsa-miR-499a-5p | 2622 | 3643 | heart, cardiac stem cells | cardiovascular disease | cardiomyocyte differentiation |
| hsa-miR-499b-3p | 2623 | 3644 | heart, cardiac stem cells | cardiovascular disease | cardiomyocyte differentiation |
| hsa-miR-499b-5p | 2624 | 3645 | heart, cardiac stem cells | cardiovascular disease | cardiomyocyte differentiation |
| hsa-miR-5000-3p | 2625 | 3646 | discovered in lymphoblastic leukaemia | | |
| hsa-miR-5000-5p | 2626 | 3647 | discovered in lymphoblastic leukaemia | | |
| hsa-miR-5001-3p | 2627 | 3648 | | | |
| hsa-miR-5001-5p | 2628 | 3649 | | | |
| hsa-miR-5002-3p | 2629 | 3650 | | | |
| hsa-miR-5002-5p | 2630 | 3651 | | | |
| hsa-miR-5003-3p | 2631 | 3652 | | | |
| hsa-miR-5003-5p | 2632 | 3653 | | | |
| hsa-miR-5004-3p | 2633 | 3654 | | | |
| hsa-miR-5004-5p | 2634 | 3655 | | | |
| hsa-miR-5006-3p | 2635 | 3656 | discovered in lymphoblastic leukaemia | | |
| hsa-miR-5006-5p | 2636 | 3657 | discovered in lymphoblastic leukaemia | | |
| hsa-miR-5007-3p | 2637 | 3658 | | | |
| hsa-miR-5007-5p | 2638 | 3659 | | | |
| hsa-miR-5008-3p | 2639 | 3660 | | | |
| hsa-miR-5008-5p | 2640 | 3661 | | | |
| hsa-miR-5009-3p | 2641 | 3662 | | | |
| hsa-miR-5009-5p | 2642 | 3663 | | | |
| hsa-miR-500a-3p | 2643 | 3664 | | | |
| hsa-miR-500a-5p | 2644 | 3665 | | | |
| hsa-miR-500b | 2645 | 3666 | Blood (plasma) | | |
| hsa-miR-5010-3p | 2646 | 3667 | | abnormal skin (psoriasis) | |
| hsa-miR-5010-5p | 2647 | 3668 | | abnormal skin (psoriasis) | |
| hsa-miR-5011-3p | 2648 | 3669 | | | |
| hsa-miR-5011-5p | 2649 | 3670 | | | |
| hsa-miR-501-3p | 2650 | 3671 | | | |
| hsa-miR-501-5p | 2651 | 3672 | | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-502-3p | 2652 | 3673 | | various cancers (hepatocellular, ovarian, breast) | |
| hsa-miR-502-5p | 2653 | 3674 | | various cancers (hepatocellular, ovarian, breast) | |
| hsa-miR-503-3p | 2654 | 3675 | ovary | | |
| hsa-miR-503-5p | 2655 | 3676 | ovary | | |
| hsa-miR-504 | 2656 | 3677 | | glioblastoma | |
| hsa-miR-5047 | 2657 | 3678 | | | |
| hsa-miR-505-3p | 2658 | 3679 | | breast cancer | |
| hsa-miR-505-5p | 2659 | 3680 | | breast cancer | |
| hsa-miR-506-3p | 2660 | 3681 | | various cancers | |
| hsa-miR-506-5p | 2661 | 3682 | | various cancers | |
| hsa-miR-507 | 2662 | 3683 | | | |
| hsa-miR-508-3p | 2663 | 3684 | | renal cell carcinoma | |
| hsa-miR-508-5p | 2664 | 3685 | endothelial progenitor cells (EPCs) | | |
| hsa-miR-5087 | 2665 | 3686 | | | |
| hsa-miR-5088 | 2666 | 3687 | | | |
| hsa-miR-5089-3p | 2667 | 3688 | | | |
| hsa-miR-5089-5p | 2668 | 3689 | | | |
| hsa-miR-5090 | 2669 | 3690 | | | |
| hsa-miR-5091 | 2670 | 3691 | | | |
| hsa-miR-5092 | 2671 | 3692 | | | |
| hsa-miR-5093 | 2672 | 3693 | | | |
| hsa-miR-509-3-5p | 2673 | 3694 | testis | | |
| hsa-miR-509-3p | 2674 | 3695 | | renal cell carcinoma, brain disease | |
| hsa-miR-5094 | 2675 | 3696 | | | |
| hsa-miR-5095 | 2676 | 3697 | | cervical cancer | |
| hsa-miR-509-5p | 2677 | 3698 | | metabolic syndrome, brain disease | |
| hsa-miR-5096 | 2678 | 3699 | | cervical cance | |
| hsa-miR-510 | 2679 | 3700 | brain | | |
| hsa-miR-5100 | 2680 | 3701 | discoverd in Salivary gland | | |
| hsa-miR-511 | 2681 | 3702 | dendritic cells and macrophages | | |
| hsa-miR-512-3p | 2682 | 3703 | embryonic stem cells, placenta | | |
| hsa-miR-512-5p | 2683 | 3704 | embryonic stem cells, placenta, | | |
| hsa-miR-513a-3p | 2684 | 3705 | | lung carcinoma | |
| hsa-miR-513a-5p | 2685 | 3706 | endothelial cells | | |
| hsa-miR-513b | 2686 | 3707 | | follicular lymphoma | |
| hsa-miR-513c-3p | 2687 | 3708 | | | |
| hsa-miR-513c-5p | 2688 | 3709 | | | |
| hsa-miR-514a-3p | 2689 | 3710 | | | |
| hsa-miR-514a-5p | 2690 | 3711 | | | |
| hsa-miR-514b-3p | 2691 | 3712 | | various cancer cells | |
| hsa-miR-514b-5p | 2692 | 3713 | | various cancer cells | |
| hsa-miR-515-3p | 2693 | 3714 | | | |
| hsa-miR-515-5p | 2694 | 3715 | placenta | | |
| hsa-miR-516a-3p | 2695 | 3716 | frontal cortex | | |
| hsa-miR-516a-5p | 2696 | 3717 | placenta | | |
| hsa-miR-516b-3p | 2697 | 3718 | | | |
| hsa-miR-516b-5p | 2698 | 3719 | | | |
| hsa-miR-517-5p | 2699 | 3720 | placenta | | |
| hsa-miR-517a-3p | 2700 | 3721 | placenta | | |
| hsa-miR-517b-3p | 2701 | 3722 | placenta | | |
| hsa-miR-517c-3p | 2702 | 3723 | placenta | | |
| hsa-miR-5186 | 2703 | 3724 | discovered in lymphoblastic leukaemia | | |
| hsa-miR-5187-3p | 2704 | 3725 | discovered in lymphoblastic | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-5187-5p | 2705 | 3726 | leukaemia, skin (psoriasis) discovered in lymphoblastic leukaemia, skin (psoriasis) | | |
| hsa-miR-5188 | 2706 | 3727 | discovered in lymphoblastic leukaemia | | |
| hsa-miR-5189 | 2707 | 3728 | discovered in lymphoblastic leukaemia | | |
| hsa-miR-518a-3p | 2708 | 3729 | | HCC | |
| hsa-miR-518a-5p | 2709 | 3730 | | various cancer cells | |
| hsa-miR-518b | 2710 | 3731 | placenta | HCC | cell cycle progression |
| hsa-miR-518c-3p | 2711 | 3732 | placenta | | |
| hsa-miR-518c-5p | 2712 | 3733 | placenta | | |
| hsa-miR-518d-3p | 2713 | 3734 | | | |
| hsa-miR-518d-5p | 2714 | 3735 | | | |
| hsa-miR-518e-3p | 2715 | 3736 | | HCC | cell cycle progression |
| hsa-miR-518e-5p | 2716 | 3737 | | HCC | cell cycle progression |
| hsa-miR-518f-3p | 2717 | 3738 | placenta | | |
| hsa-miR-518f-5p | 2718 | 3739 | placenta | | |
| hsa-miR-5190 | 2719 | 3740 | discovered in lymphoblastic leukaemia | | |
| hsa-miR-5191 | 2720 | 3741 | discovered in lymphoblastic leukaemia | | |
| hsa-miR-5192 | 2721 | 3742 | discovered in lymphoblastic leukaemia | | |
| hsa-miR-5193 | 2722 | 3743 | discovered in lymphoblastic leukaemia | | |
| hsa-miR-5194 | 2723 | 3744 | discovered in lymphoblastic leukaemia | | |
| hsa-miR-5195-3p | 2724 | 3745 | discovered in lymphoblastic leukaemia | | |
| hsa-miR-5195-5p | 2725 | 3746 | discovered in lymphoblastic leukaemia | | |
| hsa-miR-5196-3p | 2726 | 3747 | discovered in lymphoblastic leukaemia | | |
| hsa-miR-5196-5p | 2727 | 3748 | discovered in lymphoblastic leukaemia | | |
| hsa-miR-5197-3p | 2728 | 3749 | discovered in lymphoblastic leukaemia | | |
| hsa-miR-5197-5p | 2729 | 3750 | discovered in lymphoblastic leukaemia | | |
| hsa-miR-519a-3p | 2730 | 3751 | placenta | HCC | |
| hsa-miR-519a-5p | 2731 | 3752 | placenta | HCC | |
| hsa-miR-519b-3p | 2732 | 3753 | | breast cancer | |
| hsa-miR-519b-5p | 2733 | 3754 | | breast cancer | |
| hsa-miR-519c-3p | 2734 | 3755 | | | |
| hsa-miR-519c-5p | 2735 | 3756 | | | |
| hsa-miR-519d | 2736 | 3757 | placenta | | |
| hsa-miR-519e-3p | 2737 | 3758 | placenta | | |
| hsa-miR-519e-5p | 2738 | 3759 | placenta | | |
| hsa-miR-520a-3p | 2739 | 3760 | placenta | | |
| hsa-miR-520a-5p | 2740 | 3761 | placenta | | |
| hsa-miR-520b | 2741 | 3762 | | breast cancer | |
| hsa-miR-520c-3p | 2742 | 3763 | | gastric cancer, breast tumor | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-520c-5p | 2743 | 3764 | | breast tumor | |
| hsa-miR-520d-3p | 2744 | 3765 | | various cancer cells | |
| hsa-miR-520d-5p | 2745 | 3766 | | various cancer cells | |
| hsa-miR-520e | 2746 | 3767 | | hepatoma | tomor suppressor |
| hsa-miR-520f | 2747 | 3768 | | breast cancer | |
| hsa-miR-520g | 2748 | 3769 | | HCC, bladder cancer, breast cancer | |
| hsa-miR-520h | 2749 | 3770 | placental specific | | |
| hsa-miR-521 | 2750 | 3771 | | prostate cancer | |
| hsa-miR-522-3p | 2751 | 3772 | | HCC | |
| hsa-miR-522-5p | 2752 | 3773 | | HCC | |
| hsa-miR-523-3p | 2753 | 3774 | | | |
| hsa-miR-523-5p | 2754 | 3775 | | | |
| hsa-miR-524-3p | 2755 | 3776 | | colon cancer stem cells | |
| hsa-miR-524-5p | 2756 | 3777 | placental specific | gliomas | |
| hsa-miR-525-3p | 2757 | 3778 | placental specific | HCC | |
| hsa-miR-525-5p | 2758 | 3779 | placental specific | | |
| hsa-miR-526a | 2759 | 3780 | placental specific | | |
| hsa-miR-526b-3p | 2760 | 3781 | placental specific | | |
| hsa-miR-526b-5p | 2761 | 3782 | placental specific | | |
| hsa-miR-527 | 2762 | 3783 | | | |
| hsa-miR-532-3p | 2763 | 3784 | | ALL | |
| hsa-miR-532-5p | 2764 | 3785 | | ALL | |
| hsa-miR-539-3p | 2765 | 3786 | | | |
| hsa-miR-539-5p | 2766 | 3787 | | | |
| hsa-miR-541-3p | 2767 | 3788 | | | |
| hsa-miR-541-5p | 2768 | 3789 | | | |
| hsa-miR-542-3p | 2769 | 3790 | monocytes | | |
| hsa-miR-542-5p | 2770 | 3791 | | basal cell carcinoma, neuroblastoma | |
| hsa-miR-543 | 2771 | 3792 | | | |
| hsa-miR-544a | 2772 | 3793 | | osteocarcoma | |
| hsa-miR-544b | 2773 | 3794 | | osteocarcoma | |
| hsa-miR-545-3p | 2774 | 3795 | | | |
| hsa-miR-545-5p | 2775 | 3796 | | rectal cancer | |
| hsa-miR-548 | 2776 | 3797 | | | |
| hsa-miR-548-3p | 2777 | 3798 | | | |
| hsa-miR-548-5p | 2778 | 3799 | | | |
| hsa-miR-548a | 2779 | 3800 | identified in colorectal microRNAome | | |
| hsa-miR-548a-3p | 2780 | 3801 | identified in colorectal microRNAome | | |
| hsa-miR-548a-5p | 2781 | 3802 | identified in colorectal microRNAome | | |
| hsa-miR-548aa | 2782 | 3803 | identified in cervical tumor | | |
| hsa-miR-548ab | 2783 | 3804 | discovered in B-cells | | |
| hsa-miR-548ac | 2784 | 3805 | discovered in B-cells | | |
| hsa-miR-548ad | 2785 | 3806 | discovered in B-cells | | |
| hsa-miR-548ae | 2786 | 3807 | discovered in B-cells | | |
| hsa-miR-548ag | 2787 | 3808 | discovered in B-cells | | |
| hsa-miR-548ah-3p | 2788 | 3809 | discovered in B-cells | | |
| hsa-miR-548ah-5p | 2789 | 3810 | discovered in B-cells | | |
| hsa-miR-548ai | 2790 | 3811 | discovered in B-cells | | |
| hsa-miR-548aj-3p | 2791 | 3812 | discovered in B-cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-548aj-5p | 2792 | 3813 | discovered in B-cells | | |
| hsa-miR-548ak | 2793 | 3814 | discovered in B-cells | | |
| hsa-miR-548al | 2794 | 3815 | discovered in B-cells | | |
| hsa-miR-548am-3p | 2795 | 3816 | discovered in B-cells | | |
| hsa-miR-548am-5p | 2796 | 3817 | discovered in B-cells | | |
| hsa-miR-548an | 2797 | 3818 | discovered in B-cells | | |
| hsa-miR-548ao-3p | 2798 | 3819 | | | |
| hsa-miR-548ao-5p | 2799 | 3820 | | | |
| hsa-miR-548ap-3p | 2800 | 3821 | | | |
| hsa-miR-548ap-5p | 2801 | 3822 | | | |
| hsa-miR-548aq-3p | 2802 | 3823 | | | |
| hsa-miR-548aq-5p | 2803 | 3824 | | | |
| hsa-miR-548ar-3p | 2804 | 3825 | | | |
| hsa-miR-548ar-5p | 2805 | 3826 | | | |
| hsa-miR-548as-3p | 2806 | 3827 | | | |
| hsa-miR-548as-5p | 2807 | 3828 | | | |
| hsa-miR-548at-3p | 02808 | 3829 | | prostate cancer | |
| hsa-miR-548at-5p | 2809 | 3830 | | prostate cancer | |
| hsa-miR-548au-3p | 2810 | 3831 | | | |
| hsa-miR-548au-5p | 2811 | 3832 | | | |
| hsa-miR-548av-3p | 2812 | 3833 | | | |
| hsa-miR-548av-5p | 2813 | 3834 | | | |
| hsa-miR-548aw | 2814 | 3835 | | prostate cancer | |
| hsa-miR-548ay-3p | 2815 | 3836 | discovered in abnormal skin (psoriasis) | | |
| hsa-miR-548ay-5p | 2816 | 3837 | discovered in abnormal skin (psoriasis) | | |
| hsa-miR-548az-3p | 2817 | 3838 | discovered in abnormal skin (psoriasis) | | |
| hsa-miR-548az-5p | 2818 | 3839 | discovered in abnormal skin (psoriasis) | | |
| hsa-miR-548b-3p | 2819 | 3840 | identified in colorectal microRNAome | | |
| hsa-miR-548b-5p | 2820 | 3841 | immune cells, frontal cortex | | |
| hsa-miR-548c-3p | 2821 | 3842 | identified in colorectal microRNAome | | |
| hsa-miR-548c-5p | 2822 | 3843 | immune cells, frontal cortex | | |
| hsa-miR-548d-3p | 2823 | 3844 | identified in colorectal microRNAome | | |
| hsa-miR-548d-5p | 2824 | 3845 | identified in colorectal microRNAome | | |
| hsa-miR-548e | 2825 | 3846 | embryonic stem cells | | |
| hsa-miR-548f | 2826 | 3847 | embryonic stem cells | | |
| hsa-miR-548g-3p | 2827 | 3848 | embryonic stem cells | | |
| hsa-miR-548g-5p | 2828 | 3849 | embryonic stem cells | | |
| hsa-miR-548h-3p | 2829 | 3850 | embryonic stem cells | | |
| hsa-miR-548h-5p | 2830 | 3851 | embryonic stem cells | | |
| hsa-miR-548i | 2831 | 3852 | embryonic stem cells, immune cells | | |
| hsa-miR-548j | 2832 | 3853 | immune cells | | |
| hsa-miR-548k | 2833 | 3854 | embryonic stem cells | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-5481 | 2834 | 3855 | embryonic stem cells | | |
| hsa-miR-548m | 2835 | 3856 | embryonic stem cells | | |
| hsa-miR-548n | 2836 | 3857 | embryonic stem cells, immune cells | | |
| hsa-miR-548o-3p | 2837 | 3858 | embryonic stem cells | | |
| hsa-miR-548o-5p | 2838 | 3859 | embryonic stem cells | | |
| hsa-miR-548p | 2839 | 3860 | embryonic stem cells | | |
| hsa-miR-548q | 2840 | 3861 | | ovarian cancer cells | |
| hsa-miR-548s | 2841 | 3862 | discovered in the melanoma MicroRNAome | | |
| hsa-miR-548t-3p | 2842 | 3863 | discovered in the melanoma MicroRNAome | | |
| hsa-miR-548t-5p | 2843 | 3864 | discovered in the melanoma MicroRNAome | | |
| hsa-miR-548u | 2844 | 3865 | discovered in the melanoma MicroRNAome | | |
| hsa-miR-548w | 2845 | 3866 | discovered in the melanoma MicroRNAome | | |
| hsa-miR-548y | 2846 | 3867 | / | | |
| hsa-miR-548z | 2847 | 3868 | discovered in cervical tumor | | |
| hsa-miR-549a | 2848 | 3869 | discovered in a colorectal MicroRNAome | | |
| hsa-miR-550a-3-5p | 2849 | 3870 | | Hepatocellular Carcinoma | |
| hsa-miR-550a-3p | 2850 | 3871 | | Hepatocellular Carcinoma | |
| hsa-miR-550a-5p | 2851 | 3872 | | Hepatocellular Carcinoma | |
| hsa-miR-550b-2-5p | 2852 | 3873 | discovered in cervical tumor | | |
| hsa-miR-550b-3p | 2853 | 3874 | discovered in cervical tumor | | |
| hsa-miR-551a | 2854 | 3875 | | gastric cancer | |
| hsa-miR-551b-3p | 2855 | 3876 | hepatocytes | | |
| hsa-miR-551b-5p | 2856 | 3877 | hepatocytes | | |
| hsa-miR-552 | 2857 | 3878 | discovered in a colorectal MicroRNAome | | |
| hsa-miR-553 | 2858 | 3879 | discovered in a colorectal MicroRNAome | | |
| hsa-miR-554 | 2859 | 3880 | discovered in a colorectal MicroRNAome | | |
| hsa-miR-555 | 2860 | 3881 | discovered in a colorectal MicroRNAome | | |
| hsa-miR-556-3p | 2861 | 3882 | discovered in a colorectal MicroRNAome | | |
| hsa-miR-556-5p | 2862 | 3883 | discovered in a colorectal MicroRNAome | | |
| hsa-miR-557 | 2863 | 3884 | liver(hepatocytes) | | |
| hsa-miR-5571-3p | 2864 | 3885 | discoveredd in Salivary gland | | |
| hsa-miR-5571-5p | 2865 | 3886 | discoveredd in Salivary gland | | |
| hsa-miR-5572 | 2866 | 3887 | discoveredd in Salivary gland | | |
| hsa-miR-5579-3p | 2867 | 3888 | | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-5579-5p | 2868 | 3889 | | | |
| hsa-miR-558 | 2869 | 3890 | | neuroblastoma | |
| hsa-miR-5580-3p | 2870 | 3891 | | | |
| hsa-miR-5580-5p | 2871 | 3892 | | | |
| hsa-miR-5581-3p | 2872 | 3893 | | | |
| hsa-miR-5581-5p | 2873 | 3894 | | | |
| hsa-miR-5582-3p | 2874 | 3895 | | | |
| hsa-miR-5582-5p | 2875 | 3896 | | | |
| hsa-miR-5583-3p | 2876 | 3897 | | | |
| hsa-miR-5583-5p | 2877 | 3898 | | | |
| hsa-miR-5584-3p | 2878 | 3899 | | | |
| hsa-miR-5584-5p | 2879 | 3900 | | | |
| hsa-miR-5585-3p | 2880 | 3901 | | | |
| hsa-miR-5585-5p | 2881 | 3902 | | | |
| hsa-miR-5586-3p | 2882 | 3903 | | | |
| hsa-miR-5586-5p | 2883 | 3904 | | | |
| hsa-miR-5587-3p | 2884 | 3905 | | | |
| hsa-miR-5587-5p | 2885 | 3906 | | | |
| hsa-miR-5588-3p | 2886 | 3907 | | | |
| hsa-miR-5588-5p | 2887 | 3908 | | | |
| hsa-miR-5589-3p | 2888 | 3909 | | | |
| hsa-miR-5589-5p | 2889 | 3910 | | | |
| hsa-miR-559 | 2890 | 3911 | | | |
| hsa-miR-5590-3p | 2891 | 3912 | | | |
| hsa-miR-5590-5p | 2892 | 3913 | | | |
| hsa-miR-5591-3p | 2893 | 3914 | | | |
| hsa-miR-5591-5p | 2894 | 3915 | | | |
| hsa-miR-561-3p | 2895 | 3916 | | multiple myeloma | |
| hsa-miR-561-5p | 2896 | 3917 | | multiple myeloma | |
| hsa-miR-562 | 2897 | 3918 | | | |
| hsa-miR-563 | 2898 | 3919 | discovered in a colorectal MicroRNAome | | |
| hsa-miR-564 | 2899 | 3920 | | Chronic myeloid leukemia | |
| hsa-miR-566 | 2900 | 3921 | | MALT lymphoma/lymphocyte | |
| hsa-miR-567 | 2901 | 3922 | | colorectal cancer | |
| hsa-miR-568 | 2902 | 3923 | discovered in a colorectal MicroRNAome | | |
| hsa-miR-5680 | 2903 | 3924 | | Associated with metastatic prostate cancer | |
| hsa-miR-5681a | 2904 | 3925 | | Associated with metastatic prostate cancer | |
| hsa-miR-5681b | 2905 | 3926 | | Associated with metastatic prostate cancer | |
| hsa-miR-5682 | 2906 | 3927 | | Associated with metastatic prostate cancer | |
| hsa-miR-5683 | 2907 | 3928 | | Associated with metastatic prostate cancer | |
| hsa-miR-5684 | 2908 | 3929 | | Associated with metastatic prostate cancer | |
| hsa-miR-5685 | 2909 | 3930 | | Associated with metastatic prostate cancer | |
| hsa-miR-5686 | 2910 | 3931 | | Associated with metastatic prostate cancer | |
| hsa-miR-5687 | 2911 | 3932 | | Associated with metastatic prostate cancer | |
| hsa-miR-5688 | 2912 | 3933 | | Associated with metastatic prostate cancer | |
| hsa-miR-5689 | 2913 | 3934 | | Associated with metastatic prostate cancer | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-569 | 2914 | 3935 | | | |
| hsa-miR-5690 | 2915 | 3936 | | Associated with metastatic prostate cancer | |
| hsa-miR-5691 | 2916 | 3937 | | Associated with metastatic prostate cancer | |
| hsa-miR-5692a | 2917 | 3938 | | Associated with metastatic prostate cancer | |
| hsa-miR-5692b | 2918 | 3939 | | Associated with metastatic prostate cancer | |
| hsa-miR-5692c | 2919 | 3940 | | Associated with metastatic prostate cancer | |
| hsa-miR-5693 | 2920 | 3941 | | Associated with metastatic prostate cancer | |
| hsa-miR-5694 | 2921 | 3942 | | Associated with metastatic prostate cancer | |
| hsa-miR-5695 | 2922 | 3943 | | Associated with metastatic prostate cancer | |
| hsa-miR-5696 | 2923 | 3944 | | Associated with metastatic prostate cancer | |
| hsa-miR-5697 | 2924 | 3945 | | Associated with metastatic prostate cancer | |
| hsa-miR-5698 | 2925 | 3946 | | Associated with metastatic prostate cancer | |
| hsa-miR-5699 | 2926 | 3947 | | Associated with metastatic prostate cancer | |
| hsa-miR-5700 | 2927 | 3948 | | Associated with metastatic prostate cancer | |
| hsa-miR-5701 | 2928 | 3949 | | Associated with metastatic prostate cancer | |
| hsa-miR-5702 | 2929 | 3950 | | Associated with metastatic prostate cancer | |
| hsa-miR-5703 | 2930 | 3951 | | Associated with metastatic prostate cancer | |
| hsa-miR-570-3p | 2931 | 3952 | | follicular lymphoma | |
| hsa-miR-5704 | 2932 | 3953 | | Associated with metastatic prostate cancer | |
| hsa-miR-5705 | 2933 | 3954 | | Associated with metastatic prostate cancer | |
| hsa-miR-570-5p | 2934 | 3955 | | follicular lymphoma | |
| hsa-miR-5706 | 2935 | 3956 | | Associated with metastatic prostate cancer | |
| hsa-miR-5707 | 2936 | 3957 | | Associated with metastatic prostate cancer | |
| hsa-miR-5708 | 2937 | 3958 | | Associated with metastatic prostate cancer | |
| hsa-miR-571 | 2938 | 3959 | frontal cortex | | |
| hsa-miR-572 | 2939 | 3960 | circulating microRNA (in plasma) | basal cell carcinoma | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-573 | 2940 | 3961 | discovered in the colorectal MicroRNAome | | |
| hsa-miR-5739 | 2941 | 3962 | endothelial cells | | |
| hsa-miR-574-3p | 2942 | 3963 | blood (myeloid cells) | follicular lymphoma | |
| hsa-miR-574-5p | 2943 | 3964 | semen | | |
| hsa-miR-575 | 2944 | 3965 | | gastric cancer | |
| hsa-miR-576-3p | 2945 | 3966 | discovered in a colorectal MicroRNAome | | |
| hsa-miR-576-5p | 2946 | 3967 | cartilage/chondrocyte | | |
| hsa-miR-577 | 2947 | 3968 | discovered in a colorectal MicroRNAome | | |
| hsa-miR-578 | 2948 | 3969 | discovered in a colorectal MicroRNAome | | |
| hsa-miR-5787 | 2949 | 3970 | fibroblast | | |
| hsa-miR-579 | 2950 | 3971 | | | |
| hsa-miR-580 | 2951 | 3972 | | breast cancer | |
| hsa-miR-581 | 2952 | 3973 | liver(hepatocytes) | | |
| hsa-miR-582-3p | 2953 | 3974 | cartilage/chondrocyte | bladder cancer | |
| hsa-miR-582-5p | 2954 | 3975 | | bladder cancer | |
| hsa-miR-583 | 2955 | 3976 | | rectal cancer cells | |
| hsa-miR-584-3p | 2956 | 3977 | | tumor cells (follicular lymphoma, rectal cancer cells) | |
| hsa-miR-584-5p | 2957 | 3978 | | tumor cells (follicular lymphoma, rectal cancer cells) | |
| hsa-miR-585 | 2958 | 3979 | | oral squamous cell carcinoma | |
| hsa-miR-586 | 2959 | 3980 | discovered in a colorectal MicroRNAome | | |
| hsa-miR-587 | 2960 | 3981 | discovered in a colorectal MicroRNAome | | |
| hsa-miR-588 | 2961 | 3982 | discovered in a colorectal MicroRNAome | | |
| hsa-miR-589-3p | 2962 | 3983 | mesothelial cells | | |
| hsa-miR-589-5p | 2963 | 3984 | mesothelial cells | | |
| hsa-miR-590-3p | 2964 | 3985 | cardiomyocytes | | Cell cycle progression |
| hsa-miR-590-5p | 2965 | 3986 | cardiomyocytes | | Cell cycle progression |
| hsa-miR-591 | 2966 | 3987 | | neuroblastoma | |
| hsa-miR-592 | 2967 | 3988 | | hepatocellular carcinoma | |
| hsa-miR-593-3p | 2968 | 3989 | | esophageal cancer | |
| hsa-miR-593-5p | 2969 | 3990 | | esophageal cancer | |
| hsa-miR-595 | 2970 | 3991 | | heart failure | |
| hsa-miR-596 | 2971 | 3992 | | ependymoma, cancers | |
| hsa-miR-597 | 2972 | 3993 | discovered in a colorectal MicroRNAome | | |
| hsa-miR-598 | 2973 | 3994 | Blood (lymphocytes) | | |
| hsa-miR-599 | 2974 | 3995 | | Multiple sclerosis | |
| hsa-miR-600 | 2975 | 3996 | discovered in a colorectal MicroRNAome | | |
| hsa-miR-601 | 2976 | 3997 | | various cancers (colonrectal, gastric) | |
| hsa-miR-602 | 2977 | 3998 | oocyte | | |
| hsa-miR-603 | 2978 | 3999 | | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-604 | 2979 | 4000 | discovered in a colorectal MicroRNAome | | |
| hsa-miR-605 | 2980 | 4001 | discovered in a colorectal MicroRNAome | | |
| hsa-miR-606 | 2981 | 4002 | discovered in a colorectal MicroRNAome | | |
| hsa-miR-6068 | 2982 | 4003 | discovered in endothelial cells | | |
| hsa-miR-6069 | 2983 | 4004 | discovered in endothelial cells | | |
| hsa-miR-607 | 2984 | 4005 | discovered in a colorectal MicroRNAome | | |
| hsa-miR-6070 | 2985 | 4006 | discovered in a colorectal MicroRNAome | | |
| hsa-miR-6071 | 2986 | 4007 | discovered in endothelial cells | | |
| hsa-miR-6072 | 2987 | 4008 | discovered in endothelial cells | | |
| hsa-miR-6073 | 2988 | 4009 | discovered in endothelial cells | | |
| hsa-miR-6074 | 2989 | 4010 | discovered in endothelial cells | | |
| hsa-miR-6075 | 2990 | 4011 | discovered in endothelial cells | | |
| hsa-miR-6076 | 2991 | 4012 | discovered in endothelial cells | | |
| hsa-miR-6077 | 2992 | 4013 | discovered in endothelial cells | | |
| hsa-miR-6078 | 2993 | 4014 | discovered in endothelial cells | | |
| hsa-miR-6079 | 2994 | 4015 | discovered in endothelial cells | | |
| hsa-miR-608 | 2995 | 4016 | | various cancers | |
| hsa-miR-6080 | 2996 | 4017 | discovered in endothelial cells | | |
| hsa-miR-6081 | 2997 | 4018 | discovered in endothelial cells | | |
| hsa-miR-6082 | 2998 | 4019 | discovered in endothelial cells | | |
| hsa-miR-6083 | 2999 | 4020 | discovered in endothelial cells | | |
| hsa-miR-6084 | 3000 | 4021 | discovered in endothelial cells | | |
| hsa-miR-6085 | 3001 | 4022 | discovered in endothelial cells | | |
| hsa-miR-6086 | 3002 | 4023 | embryonic stem cells | | |
| hsa-miR-6087 | 3003 | 4024 | embryonic stem cells | | |
| hsa-miR-6088 | 3004 | 4025 | embryonic stem cells | | |
| hsa-miR-6089 | 3005 | 4026 | embryonic stem cells | | |
| hsa-miR-609 | 3006 | 4027 | discovered in a colorectal MicroRNAome | | |
| hsa-miR-6090 | 3007 | 4028 | embryonic stem cells | | |
| hsa-miR-610 | 3008 | 4029 | | gastric cancer | |
| hsa-miR-611 | 3009 | 4030 | | Renal cell carcinoma | |
| hsa-miR-612 | 3010 | 4031 | | AM leukemia | |
| hsa-miR-6124 | 3011 | 4032 | | | |
| hsa-miR-6125 | 3012 | 4033 | | | |
| hsa-miR-6126 | 3013 | 4034 | | | |
| hsa-miR-6127 | 3014 | 4035 | | | |
| hsa-miR-6128 | 3015 | 4036 | | | |
| hsa-miR-6129 | 3016 | 4037 | | | |
| hsa-miR-613 | 3017 | 4038 | lipid metabollism | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-6130 | 3018 | 4039 | | | |
| hsa-miR-6131 | 3019 | 4040 | | | |
| hsa-miR-6132 | 3020 | 4041 | | | |
| hsa-miR-6133 | 3021 | 4042 | | | |
| hsa-miR-6134 | 3022 | 4043 | | | |
| hsa-miR-614 | 3023 | 4044 | circulating micrRNAs (in Plasma) | | |
| hsa-miR-615-3p | 3024 | 4045 | | | |
| hsa-miR-615-5p | 3025 | 4046 | | | |
| hsa-miR-616-3p | 3026 | 4047 | | prostate cancer | |
| hsa-miR-6165 | 3027 | 4048 | | | Pro-apoptotic factor |
| hsa-miR-616-5p | 3028 | 4049 | | prostate cancer | |
| hsa-miR-617 | 3029 | 4050 | | | |
| hsa-miR-618 | 3030 | 4051 | | | |
| hsa-miR-619 | 3031 | 4052 | discovered in a colorectal MicroRNAome | | |
| hsa-miR-620 | 3032 | 4053 | discovered in a colorectal MicroRNAome | | |
| hsa-miR-621 | 3033 | 4054 | | | |
| hsa-miR-622 | 3034 | 4055 | | | |
| hsa-miR-623 | 3035 | 4056 | | | |
| hsa-miR-624-3p | 3036 | 4057 | chondrocyte | | |
| hsa-miR-624-5p | 3037 | 4058 | chondrocyte | | |
| hsa-miR-625-3p | 3038 | 4059 | liver(hepatocytes), circulating (blood) | various cancers | |
| hsa-miR-625-5p | 3039 | 4060 | liver(hepatocytes), circulating (blood) | various cancers | |
| hsa-miR-626 | 3040 | 4061 | discovered in the colorectal MicroRNAome | | |
| hsa-miR-627 | 3041 | 4062 | | colorectal cancer | |
| hsa-miR-628-3p | 3042 | 4063 | | neuroblastoma | |
| hsa-miR-628-5p | 3043 | 4064 | | neuroblastoma | |
| hsa-miR-629-3p | 3044 | 4065 | | B-lineage ALL, T cell lupus, RCC/kidney | |
| hsa-miR-629-5p | 3045 | 4066 | | B-lineage ALL, T cell lupus, RCC/kidney | |
| hsa-miR-630 | 3046 | 4067 | chondrocytes | rectal cancer | |
| hsa-miR-631 | 3047 | 4068 | discovered in the colorectal MicroRNAom | | |
| hsa-miR-632 | 3048 | 4069 | | myelodysplastic syndromes | |
| hsa-miR-633 | 3049 | 4070 | | multiple sclerosis | |
| hsa-miR-634 | 3050 | 4071 | cartilage/chondrocyte | | |
| hsa-miR-635 | 3051 | 4072 | discovered in the colorectal MicroRNAome | | |
| hsa-miR-636 | 3052 | 4073 | | myelodysplastic syndromes | |
| hsa-miR-637 | 3053 | 4074 | discovered in the colorectal MicroRNAome | | |
| hsa-miR-638 | 3054 | 4075 | | Lupus nephritis, basal cell carcinoma | |
| hsa-miR-639 | 3055 | 4076 | discovered in the colorectal MicroRNAome | | |
| hsa-miR-640 | 3056 | 4077 | | Chronic lymphocytic leukemia | |
| hsa-miR-641 | 3057 | 4078 | cartilage/chondrocyte | | |
| hsa-miR-642a-3p | 3058 | 4079 | adipocyte | | |
| hsa-miR-642a-5p | 3059 | 4080 | discovered in the colorectal MicroRNAome | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-642b-3p | 3060 | 4081 | discovered in a cervial tumo | | |
| hsa-miR-642b-5p | 3061 | 4082 | discovered in a cervial tumo | | |
| hsa-miR-643 | 3062 | 4083 | discovered in the colorectal MicroRNAome | | |
| hsa-miR-644a | 3063 | 4084 | | | |
| hsa-miR-645 | 3064 | 4085 | | ovarian cancer | |
| hsa-miR-646 | 3065 | 4086 | | | |
| hsa-miR-647 | 3066 | 4087 | | prostate and lung cancer | |
| hsa-miR-648 | 3067 | 4088 | circulating micrRNAs (in Plasma) | | |
| hsa-miR-649 | 3068 | 4089 | Serum | | |
| hsa-miR-6499-3p | 3069 | 4090 | discovered in abnormal skin (psoriasis) | | |
| hsa-miR-6499-5p | 3070 | 4091 | discovered in abnormal skin (psoriasis) | | |
| hsa-miR-650 | 3071 | 4092 | | melanoma | |
| hsa-miR-6500-3p | 3072 | 4093 | discovered in abnormal skin (psoriasis) | | |
| hsa-miR-6500-5p | 3073 | 4094 | discovered in abnormal skin (psoriasis) | | |
| hsa-miR-6501-3p | 3074 | 4095 | discovered in abnormal skin (psoriasis) | | |
| hsa-miR-6501-5p | 3075 | 4096 | discovered in abnormal skin (psoriasis) | | |
| hsa-miR-6502-3p | 3076 | 4097 | discovered in abnormal skin (psoriasis) | | |
| hsa-miR-6502-5p | 3077 | 4098 | discovered in abnormal skin (psoriasis) | | |
| hsa-miR-6503-3p | 3078 | 4099 | discovered in abnormal skin (psoriasis) | | |
| hsa-miR-6503-5p | 3079 | 4100 | discovered in abnormal skin (psoriasis) | | |
| hsa-miR-6504-3p | 3080 | 4101 | discovered in abnormal skin (psoriasis) | | |
| hsa-miR-6504-5p | 3081 | 4102 | discovered in abnormal skin (psoriasis) | | |
| hsa-miR-6505-3p | 3082 | 4103 | discovered in abnormal skin (psoriasis) | | |
| hsa-miR-6505-5p | 3083 | 4104 | discovered in abnormal skin (psoriasis) | | |
| hsa-miR-6506-3p | 3084 | 4105 | discovered in abnormal skin (psoriasis) | | |
| hsa-miR-6506-5p | 3085 | 4106 | discovered in abnormal skin (psoriasis) | | |
| hsa-miR-6507-3p | 3086 | 4107 | discovered in abnormal skin (psoriasis) | | |
| hsa-miR-6507-5p | 3087 | 4108 | discovered in abnormal skin (psoriasis) | | |
| hsa-miR-6508-3p | 3088 | 4109 | discovered in abnormal skin (psoriasis) | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-6508-5p | 3089 | 4110 | discovered in abnormal skin (psoriasis) | | |
| hsa-miR-6509-3p | 3090 | 4111 | discovered in abnormal skin (psoriasis) | | |
| hsa-miR-6509-5p | 3091 | 4112 | discovered in abnormal skin (psoriasis) | | |
| hsa-miR-651 | 3092 | 4113 | discovered in the colorectal MicroRNAome | lung cancer | |
| hsa-miR-6510-3p | 3093 | 4114 | discovered in abnormal skin (psoriasis) | | |
| hsa-miR-6510-5p | 3094 | 4115 | discovered in abnormal skin (psoriasis) | | |
| hsa-miR-6511a-3p | 3095 | 4116 | discovered in abnormal skin (psoriasis) and epididymis | | |
| hsa-miR-6511a-5p | 3096 | 4117 | discovered in abnormal skin (psoriasis) and epididymis | | |
| hsa-miR-6511b-3p | 3097 | 4118 | discovered in epididymis | | |
| hsa-miR-6511b-5p | 3098 | 4119 | discovered in epididymis | | |
| hsa-miR-6512-3p | 3099 | 4120 | discovered in abnormal skin (psoriasis) | | |
| hsa-miR-6512-5p | 3100 | 4121 | discovered in abnormal skin (psoriasis) | | |
| hsa-miR-6513-3p | 3101 | 4122 | discovered in abnormal skin (psoriasis) | | |
| hsa-miR-6513-5p | 3102 | 4123 | discovered in abnormal skin (psoriasis) | | |
| hsa-miR-6514-3p | 3103 | 4124 | discovered in abnormal skin (psoriasis) | | |
| hsa-miR-6514-5p | 3104 | 4125 | discovered in abnormal skin (psoriasis) | | |
| hsa-miR-6515-3p | 3105 | 4126 | discovered in abnormal skin (psoriasis) and epididymis | | |
| hsa-miR-6515-5p | 3106 | 4127 | discovered in abnormal skin (psoriasis) and epididymis | | |
| hsa-miR-652-3p | 3107 | 4128 | | rectal cancer cells | |
| hsa-miR-652-5p | 3108 | 4129 | | rectal cancer cells | |
| hsa-miR-653 | 3109 | 4130 | Discovered in the colorectal MicroRNAome | | |
| hsa-miR-654-3p | 3110 | 4131 | Discovered in the colorectal MicroRNAome | | |
| hsa-miR-654-5p | 3111 | 4132 | bone marrow | prostate cancer | |
| hsa-miR-655 | 3112 | 4133 | | | |
| hsa-miR-656 | 3113 | 4134 | | various cancers | |
| hsa-miR-657 | 3114 | 4135 | oligodendrocytes | diabetes | |
| hsa-miR-658 | 3115 | 4136 | | gastric cancer | |
| hsa-miR-659-3p | 3116 | 4137 | myoblast | | |
| hsa-miR-659-5p | 3117 | 4138 | myoblast | | |
| hsa-miR-660-3p | 3118 | 4139 | myoblast | | |
| hsa-miR-660-5p | 3119 | 4140 | myoblast | | |
| hsa-miR-661 | 3120 | 4141 | | breast cancer | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-662 | 3121 | 4142 | endothelial progenitor cells, oocytes | | |
| hsa-miR-663a | 3122 | 4143 | | follicular lymphoma, Lupus nephritis | |
| hsa-miR-663b | 3123 | 4144 | | follicular lymphoma, Lupus nephritis | |
| hsa-miR-664a-3p | 3124 | 4145 | embryonic stem cells | | component of SnoRNAs |
| hsa-miR-664a-5p | 3125 | 4146 | embryonic stem cells | | component of SnoRNAs |
| hsa-miR-664b-3p | 3126 | 4147 | embryonic stem cells | | component of SnoRNAs |
| hsa-miR-664b-5p | 3127 | 4148 | embryonic stem cells | | component of SnoRNAs |
| hsa-miR-665 | 3128 | 4149 | | breast cancer | |
| hsa-miR-668 | 3129 | 4150 | keratinocytes | | senescence |
| hsa-miR-670 | 3130 | 4151 | | | |
| hsa-miR-671-3p | 3131 | 4152 | | | |
| hsa-miR-6715a-3p | 3132 | 4153 | discovered in epididymis | | |
| hsa-miR-6715b-3p | 3133 | 4154 | discovered in epididymis | | |
| hsa-miR-6715b-5p | 3134 | 4155 | discovered in epididymis | | |
| hsa-miR-671-5p | 3135 | 4156 | | rectal cancer, prolactinomas | |
| hsa-miR-6716-3p | 3136 | 4157 | discovered in epididymis | | |
| hsa-miR-6716-5p | 3137 | 4158 | discovered in epididymis | | |
| hsa-miR-6717-5p | 3138 | 4159 | discovered in epididymis | | |
| hsa-miR-6718-5p | 3139 | 4160 | discovered in epididymis | | |
| hsa-miR-6719-3p | 3140 | 4161 | discovered in epididymis | | |
| hsa-miR-6720-3p | 3141 | 4162 | discovered in epididymis | | |
| hsa-miR-6721-5p | 3142 | 4163 | discovered in epididymis | | |
| hsa-miR-6722-3p | 3143 | 4164 | discovered in epididymis | | |
| hsa-miR-6722-5p | 3144 | 4165 | discovered in epididymis | | |
| hsa-miR-6723-5p | 3145 | 4166 | discovered in epididymis | | |
| hsa-miR-6724-5p | 3146 | 4167 | discovered in epididymis | | |
| hsa-miR-675-3p | 3147 | 4168 | | adrenocortical tumor | |
| hsa-miR-675-5p | 3148 | 4169 | | adrenocortical tumor | |
| hsa-miR-676-3p | 3149 | 4170 | discovered in female reproductuve tract | | |
| hsa-miR-676-5p | 3150 | 4171 | discovered in female reproductuve tract | | |
| hsa-miR-708-3p | 3151 | 4172 | | Various cancers (lung, bladder, pancreatic, ALL) | |
| hsa-miR-708-5p | 3152 | 4173 | | Various cancers (lung, bladder, pancreatic, ALL) | |
| hsa-miR-711 | 3153 | 4174 | | cutaneous T-cell lymphomas | |
| hsa-miR-7-1-3p | 3154 | 4175 | Glioblast, brain, prancreas | | |
| hsa-miR-718 | 3155 | 4176 | blood | | |
| hsa-miR-7-2-3p | 3156 | 4177 | brain, pancreas | | |
| hsa-miR-744-3p | 3157 | 4178 | heart | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-744-5p | 3158 | 4179 | embryonic stem cells, heart | | |
| hsa-miR-758-3p | 3159 | 4180 | cholesterol regulation and brain | | |
| hsa-miR-758-5p | 3160 | 4181 | cholesterol regulation and brain | | |
| hsa-miR-759 | 3161 | 4182 | | | |
| hsa-miR-7-5p | 3162 | 4183 | brain | | |
| hsa-miR-760 | 3163 | 4184 | | colonrectal and breast cancer | |
| hsa-miR-761 | 3164 | 4185 | | | |
| hsa-miR-762 | 3165 | 4186 | corneal epithelial cells | | |
| hsa-miR-764 | 3166 | 4187 | osteoblast | | |
| hsa-miR-765 | 3167 | 4188 | | rectal cancer | |
| hsa-miR-766-3p | 3168 | 4189 | embryonic stem cells | | |
| hsa-miR-766-5p | 3169 | 4190 | embryonic stem cells | | |
| hsa-miR-767-3p | 3170 | 4191 | | | |
| hsa-miR-767-5p | 3171 | 4192 | | | |
| hsa-miR-769-3p | 3172 | 4193 | | | |
| hsa-miR-769-5p | 3173 | 4194 | | | |
| hsa-miR-770-5p | 3174 | 4195 | | | |
| hsa-miR-802 | 3175 | 4196 | brain, epithelial cells, hepatocytes | down symdrome | |
| hsa-miR-873-3p | 3176 | 4197 | | | |
| hsa-miR-873-5p | 3177 | 4198 | | | |
| hsa-miR-874 | 3178 | 4199 | | cervical cancer, lung cancer, carcinoma | |
| hsa-miR-875-3p | 3179 | 4200 | | | |
| hsa-miR-875-5p | 3180 | 4201 | | | |
| hsa-miR-876-3p | 3181 | 4202 | | | |
| hsa-miR-876-5p | 3182 | 4203 | | | |
| hsa-miR-877-3p | 3183 | 4204 | | | |
| hsa-miR-877-5p | 3184 | 4205 | | | |
| hsa-miR-885-3p | 3185 | 4206 | embryonic stem cells | | |
| hsa-miR-885-5p | 3186 | 4207 | embryonic stem cells | | |
| hsa-miR-887 | 3187 | 4208 | | | |
| hsa-miR-888-3p | 3188 | 4209 | | | |
| hsa-miR-888-5p | 3189 | 4210 | | | |
| hsa-miR-889 | 3190 | 4211 | | | |
| hsa-miR-890 | 3191 | 4212 | epididymis | | |
| hsa-miR-891a | 3192 | 4213 | epididymis | osteosarcoma | |
| hsa-miR-891b | 3193 | 4214 | epididymis | | |
| hsa-miR-892a | 3194 | 4215 | epididymis | | |
| hsa-miR-892b | 3195 | 4216 | epididymis | | |
| hsa-miR-892c-3p | 3196 | 4217 | discovered in epididymis | | |
| hsa-miR-892c-5p | 3197 | 4218 | discovered in epididymis | | |
| hsa-miR-920 | 3198 | 4219 | human testis | | |
| hsa-miR-921 | 3199 | 4220 | human testis | muscle invasive bladder cancer | |
| hsa-miR-922 | 3200 | 4221 | human testis, neuronal tissues | multiple sclerosis, Alcoholic liver disease | |
| hsa-miR-924 | 3201 | 4222 | human testis | | |
| hsa-miR-92a-1-5p | 3202 | 4223 | endothelial cells | | |
| hsa-miR-92a-2-5p | 3203 | 4224 | endothelial cells | | |
| hsa-miR-92a-3p | 3204 | 4225 | endothelial cells, CNS | | |
| hsa-miR-92b-3p | 3205 | 4226 | endothelial cells, heart | | |
| hsa-miR-92b-5p | 3206 | 4227 | endothelial cells, heart | | |
| hsa-miR-933 | 3207 | 4228 | discovered in cervical cancer | | |

TABLE 12-continued mirs, tissues/cell expression and diseases

| microRNA | mir SEQ ID | BS SEQ ID | Tissues/cells | Associated disease | Biological function |
|---|---|---|---|---|---|
| hsa-miR-93-3p | 3208 | 4229 | embryonic stem cells | basal cell carcinoma | |
| hsa-miR-934 | 3209 | 4230 | discovered in cervical cancer | | |
| hsa-miR-935 | 3210 | 4231 | blood monoclear cells | energy metabolism/ obesity, medullablastoma/neural stem cells | |
| hsa-miR-93-5p | 3211 | 4232 | embryonic stem cells | | |
| hsa-miR-936 | 3212 | 4233 | skin | | |
| hsa-miR-937-3p | 3213 | 4234 | | cervical cancer | |
| hsa-miR-937-5p | 3214 | 4235 | | cervical cancer | |
| hsa-miR-938 | 3215 | 4236 | | Various cancer cells | |
| hsa-miR-939-3p | 3216 | 4237 | hepatocytes | | |
| hsa-miR-939-5p | 3217 | 4238 | hepatocytes | | |
| hsa-miR-9-3p | 3218 | 4239 | brain | Cancers and brain diseases | |
| hsa-miR-940 | 3219 | 4240 | identified in Cervical cancer | | |
| hsa-miR-941 | 3220 | 4241 | Embryonic stem cells | | |
| hsa-miR-942 | 3221 | 4242 | | lung cancer | |
| hsa-miR-943 | 3222 | 4243 | identified in Cervical cancer | | |
| hsa-miR-944 | 3223 | 4244 | | various cancers (cervical, pancreatic, colonrectal) | |
| hsa-miR-95 | 3224 | 4245 | | various cancers (pancreatic, glioblastoma, colorectal etc) | |
| hsa-miR-9-5p | 3225 | 4246 | brain | Cancers and brain disease | |
| hsa-miR-96-3p | 3226 | 4247 | stem cells | various cancers (prostate, lymphoma, HCC, etc) and inflammation | |
| hsa-miR-96-5p | 3227 | 4248 | stem cells | various cancers (prostate, lymphoma, HCC, etc) and inflammation | |
| hsa-miR-98-3p | 3228 | 4249 | | various cancer cells | apoptosis |
| hsa-miR-98-5p | 3229 | 4250 | | various cancer cells | apoptosis |
| hsa-miR-99a-3p | 3230 | 4251 | hemapoietic cells | | |
| hsa-miR-99a-5p | 3231 | 4252 | hemapoietic cells | | |
| hsa-miR-99b-3p | 3232 | 4253 | hemapoietic cells, embryonic stem cells | | |
| hsa-miR-99b-5p | 3233 | 4254 | hemapoietic cells, embryonic stem cells | | |

MicroRNAs that are enriched in specific types of immune cells are listed in Table 13. Furthermore, novel miroRNAs are discovered in the immune cells in the art through micro-array hybridization and microtome analysis (Jima D D et al, Blood, 2010, 116:e118-e127; Vaz C et al., BMC Genomics, 2010, 11,288, the content of each of which is incorporated herein by reference in its entirety). In Table 13, "HCC" represents hepatocellular carcinoma, "ALL" stands for acute lymphoblastsic leukemia and "CLL" stands for chrominc lymphocytic leukemia.

TABLE 13 microRNAs in immune cells

| microRNA | mir SEQ ID | BS SEQ ID | tissues/cells with MicroRNAs | associated diseases | biological functions/targets |
|---|---|---|---|---|---|
| hsa-let-7a-2-3p | 171 | 1192 | embryonic stem cells, lung, myeloid cells | inflammatory, various cancers (lung, cervical, breast, pancreatic, etc) | tumor suppressor, target to c-myc |
| hsa-let-7a-3p | 172 | 1193 | embryonic stem cell, lung, myeloid cells | inflammatory, various cancers (lung, cervical, breast, pancreatic, etc) | tumor suppressor, target to c-myc |
| hsa-let-7a-5p | 173 | 1194 | embryonic stem cells, lung, myeloid cells | inflammatory, various cancers (lung, cervical, breast, pancreatic, etc) | tumor suppressor, target to c-myc |
| hsa-let-7c | 176 | 1197 | dendritic cells | various cacners (cervical, pancreatic, lung, esopphageal, etc) | tumor suppressor apoptosis (target to BCL-xl) |
| hsa-let-7e-3p | 179 | 1200 | immune cells | various cancer cells, autoimmunity TLR signal pathway in endotoxin tolerance | tumor suppressor |
| hsa-let-7e-5p | 180 | 1201 | immune cells | associated with various cancer cells | tumor suppressor |
| hsa-let-7f-1-3p | 181 | 1202 | immune cells (T cells) | associated with various cancer cells | tumor suppressor |
| hsa-let-7f-2-3p | 182 | 1203 | immune cells (T cells) | associated with various cancer cells | tumor suppressor |
| hsa-let-7f-5p | 183 | 1204 | immune cells (T cells) | associated with various cancer cells | tumor suppressor |
| hsa-let-7g-3p | 184 | 1205 | hematopoietic cells, adipose, smooth muscle cells | various cancer cells (lung, breast, etc) | tumor suppressor (target to NFkB, LOX1 |
| hsa-let-7g-5p | 185 | 1206 | hematopoietic cells, adipose, smooth muscle cells | various cancer cells (lung, breast, etc) | tumor suppressor (target to NFkB, LOX1 |
| hsa-let-7i-3p | 186 | 1207 | immune cells | chronic lymphocyte leukimia | tumor suppressor |
| hsa-let-7i-5p | 187 | 1208 | immune cells | chronic lymphocyte leukimia | tumor suppressor |
| hsa-miR-10a-3p | 203 | 1224 | hematopoeitic cells | acute myeoid leukemia | oncogene, cell growth |
| hsa-miR-10a-5p | 204 | 1225 | hematopoietic cells | acute myeoid leukemia | oncogene, cell growth |
| hsa-miR-1184 | 214 | 1235 | Hematopoietic cells | downregulated in oral leukoplakia (OLK) | predited in the intron 22 of F8 gene |
| hsa-miR-125b-1-3p | 279 | 1300 | hematopoietic cells (monocytes), brain (neuron) | various cancer (ALL, prostate, HCC, etc); TLR signal pathway in endotoxin tolerance | oncogene, cell differentiation |
| hsa-miR-125b-2-3p | 280 | 1301 | hematopoietic cells (monocytes), brain (neuron) | various cancer (ALL, prostate, HCC etc); TLR signal pathway in endotoxin tolerance | oncogene cell differentiation |
| hsa-miR-125b-5p | 281 | 1302 | hematopoietic cells, brain | various cancer (Cutaneous T cell | oncogene cell differentiation |

TABLE 13-continued microRNAs in immune cells

| microRNA | mir SEQ ID | BS SEQ ID | tissues/cells with MicroRNAs | associated diseases | biological functions/targets |
|---|---|---|---|---|---|
| | | | (neuron) | lymphomas, prostate, HCC, etc); TLR signal pathway in endotoxin tolerance | |
| hsa-miR-1279 | 315 | 1336 | monocytes | | |
| hsa-miR-130a-3p | 353 | 1374 | lung, monocytes, vascular endothelial cells | various cancers (basal cell carcinoma, HCC, ovarian, etc), drug resistance | pro-angiogenic |
| hsa-miR-130a-5p | 354 | 1375 | lung, monocytes, vasscular endothelial cells | various cancers (basal cell carcinoma, HCC, ovarian, etc), drug resistance | pro-angiogenic |
| hsa-miR-132-3p | 360 | 1381 | brain (neuron), immune cells | | |
| hsa-miR-132-5p | 362 | 1383 | brain (neuron), immune cells | | |
| hsa-miR-142-3p | 383 | 1404 | meyloid cells, hematopoiesis, APC cells | | tumor suppressor, immune response |
| hsa-miR-142-5p | 384 | 1405 | meyloid cells, hematopoiesis, APC cells | | immune response |
| hsa-miR-143-5p | 386 | 1407 | vascular smooth muscle, T-cells | increased in serum after virus infection | |
| hsa-miR-146a-3p | 393 | 1414 | immune cells, hematopoiesis, cartilage, | associated with CLL, TLR signal pathway in endotoxin tolerance | |
| hsa-miR-146a-5p | 394 | 1415 | immune cells, hematopoiesis, cartilage, | associated with CLL, TLR signal pathway in endotoxin tolerance | |
| hsa-miR-146b-3p | 395 | 1416 | immune cells | cancers (thyroid carcimona) | immune response |
| hsa-miR-146b-5p | 396 | 1417 | embryoid body cells | thyroid cancer, associated with CLL | tumor invation, migration |
| hsa-miR-147a | 399 | 1420 | Macrophage | inflammatory response | |
| hsa-miR-147b | 400 | 1421 | Macrophage | inflammatory response | |
| hsa-miR-148a-3p | 401 | 1422 | hematopoietic cells | associated with CLL, T-lineage ALL | |
| hsa-miR-148a-5p | 402 | 1423 | hematopoietic cells | associated with CLL, T-lineage ALL | |
| hsa-miR-150-3p | 407 | 1428 | hematopoitic cells (lymphoid) | circulating plasma (acute myeloid leukemia) | |
| hsa-miR-150-5p | 408 | 1429 | hematopoitic cells (lymphoid) | circulating plasma (acute myeloid leukemia) | |
| hsa-miR-151b | 411 | 1432 | immune cells (B-cells) | | |
| hsa-miR-155-3p | 419 | 1440 | T/B cells, monocytes, breast | associated with CLL, TLR signal pathway in endotoxin tolerance; upregulated in B cell | |

TABLE 13-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-155-5p | 420 | 1441 | T/B cells, monocytes, breast | lymphoma (CLL) and other cancers (breast, lung, ovarian, cervical, colorectal, prostate) associated with CLL, TLR signal pathway in endotoxin tolerance, upregulated in B cell lymphoma (CLL) and other cancers (breast, lung, ovarian, cervical, colorectal, prostate) | |
| hsa-miR-15a-3p | 422 | 1443 | blood, lymphocyte, hematopoietic tissues (spleen) | chronic lymphocytic leukemia | |
| hsa-miR-15a-5p | 423 | 1444 | blood, lymphocyte, hematopoietic tissues (spleen) | chronic lymphocytic leukemia | |
| hsa-miR-15b-3p | 424 | 1445 | blood, lymphocyte, hematopoietic tissues (spleen) | | cell cycle, proliferation |
| hsa-miR-15b-5p | 425 | 1446 | blood, lymphocyte, hematopoietic tissues (spleen) | | cell cycle, proliferation |
| hsa-miR-16-1-3p | 426 | 1447 | embryonic stem cells, blood, hematopoietic tissues (spleen) | chronic lymphocytic leukemia | |
| hsa-miR-16-2-3p | 427 | 1448 | blood, lymphocyte, hematopoietic tissues (spleen) | | |
| hsa-miR-16-5p | 428 | 1449 | blood, lymphocyte, hematopoietic tissues | | |
| hsa-miR-181a-3p | 432 | 1453 | glioblast, myeloid cells, Embryonic stem cells | | |
| hsa-miR-181a-5p | 433 | 1454 | glioblast, myeloid cells, Embryonic stem cells | | |
| hsa-miR-182-3p | 439 | 1460 | immune cells | colonrectal cancer, autoimmne | immune response |
| hsa-miR-182-5p | 441 | 1462 | lung, immune cells | autoimmune | immune response |
| hsa-miR-197-3p | 490 | 1511 | blood (myeloid), other tissues | various cancers (thyroid tumor, leukemia, etc) | |
| hsa-miR-197-5p | 491 | 1512 | blood (myeloid), other tissues | various cancers (thyroid tumor, leukemia, etc) | |
| hsa-miR-21-3p | 542 | 1563 | glioblast, Blood (meyloid cells), liver, vascular endothelial cells | autoimmune, heart diseases, cancers | |
| hsa-miR-214-3p | 543 | 1564 | immune cells, pancreas | varioua cancers (melanoma, pancreatic, ovarian) | immune response |

TABLE 13-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-214-5p | 544 | 1565 | immune cells, pancreas | varioua cancers (melanoma, pancreatic, ovarian) | immune response |
| hsa-miR-21-5p | 546 | 1567 | blood (myeloid cells), liver, endothelial cells | autoimmune, heart diseases, cancers | |
| hsa-miR-221-3p | 557 | 1578 | endothelial cells, immune cells | breast cancer, upregulated in thyroid cell transformation induced by HMGA1, TLR signal pathway in endotoxin tolerance, upregulated in T cell ALL | angiogenesis/vasculogenesis |
| hsa-miR-221-5p | 558 | 1579 | endothelial cells, immune cells | breast cancer, upregulated in thyroid cell transformation induced by HMGA1, TLR signal pathway in endotoxin tolerance, upregulated in T cell ALL | angiogenesis/vasculogenesis |
| hsa-miR-223-3p | 561 | 1582 | meyloid cells | associated with CLL | |
| hsa-miR-223-5p | 562 | 1583 | meyloid cells | associated with CLL | |
| hsa-miR-23b-3p | 576 | 1597 | blood, myeloid cells | cancers (renal cancer, glioblastoma, prostate, etc) and autoimmune | |
| hsa-miR-23b-5p | 577 | 1598 | blood, myeloid cells | cancers (glioblastoma, prostate, etc) and autoimmune | |
| hsa-miR-24-1-5p | 579 | 1600 | lung, myeloid cells | | |
| hsa-miR-24-2-5p | 580 | 1601 | lung, myeloid cells | | |
| hsa-miR-24-3p | 581 | 1602 | lung, myeloid cells | | |
| hsa-miR-26a-1-3p | 590 | 1611 | embryonic stem cells, blood (T cells) | chronic lymphocyte leukemia and other cancers | cell cycle and differentiation |
| hsa-miR-26a-2-3p | 591 | 1612 | blood (Tcells), other tissues | chronic lymphocyte leukemia and other cancers | cell cycle and differentiation |
| hsa-miR-26a-5p | 592 | 1613 | blood (Tcells), other tissues | chronic lymphocyte leukemia and other cancers | cell cycle and differentiation |
| hsa-miR-26b-3p | 593 | 1614 | hematopoietic cells | | |
| hsa-miR-26b-5p | 594 | 1615 | hematopoietic cells | | |
| hsa-miR-27a-3p | 595 | 1616 | myeloid cells | various cancer cells | |
| hsa-miR-27a-5p | 596 | 1617 | myeloid cells | various cancer cells | |
| hsa-miR-27b-3p | 597 | 1618 | myeloid cells, vascular endothelial cells | various cancer cells | pro-angiogenic |
| hsa-miR-28-3p | 599 | 1620 | blood (immune cells) | B/T cell lymphoma | |

TABLE 13-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-28-5p | 600 | 1621 | blood (immune cells) | B/T cell lymphoma | |
| hsa-miR-2909 | 602 | 1623 | T-Lymphocytes | | |
| hsa-miR-29a-3p | 611 | 1632 | immuno system, colonrectun | various cancers, neurodegenerative disease | tumor suppression, immune modulation (mir-29 family) |
| hsa-miR-29a-5p | 612 | 1633 | immuno system, colonrectun | various cancers, neurodegenerative disease | adaptive immunity |
| hsa-miR-29b-1-5p | 613 | 1634 | immuno system | associated with CLL, other cancers, neurodegenerative disease | adaptive immunity |
| hsa-miR-29b-2-5p | 614 | 1635 | immuno system | associated with CLL, other cancers, | adaptive immunity |
| hsa-miR-29b-3p | 615 | 1636 | immuno system | associated with CLL, other cancers | adaptive immunity |
| hsa-miR-29c-3p | 616 | 1637 | immuno system | associated with CLL, other cancers | adaptive immunity |
| hsa-miR-29c-5p | 617 | 1638 | immuno system | associated with CLL, other cancers | adaptive immunity |
| hsa-miR-30e-3p | 647 | 1668 | myeloid cells, glia cells | | |
| hsa-miR-30e-5p | 648 | 1669 | myeloid cells, glia cells | | |
| hsa-miR-331-5p | 793 | 1814 | lymphocytes | | |
| hsa-miR-339-3p | 800 | 1821 | immune cells | | |
| hsa-miR-339-5p | 801 | 1822 | immune cells | | |
| hsa-miR-345-3p | 810 | 1831 | hematopoietic cells | increased in follicular lymphoma(53), other cancers | |
| hsa-miR-345-5p | 811 | 1832 | hematopoietic cells | increased in follicular lymphoma(53) | |
| hsa-miR-346 | 812 | 1833 | immume cells | cancer and autoimmune | |
| hsa-miR-34a-3p | 813 | 1834 | breast, myeloid cells, ciliated epithelial cells | gastric cancer, CLL, other | tumor suppressor, p53 inducible |
| hsa-miR-34a-5p | 814 | 1835 | breast, myeloid cells, ciliated epithelial cells | gastric cancer, CLL, other | tumor suppressor, p53 inducible |
| hsa-miR-363-3p | 856 | 1877 | kidney stem cell, blood cells | | |
| hsa-miR-363-5p | 857 | 1878 | kidney stem cell, blood cells | | |
| hsa-miR-372 | 940 | 1961 | hematopoietic cells, lung, placental (blood) | | |
| hsa-miR-377-3p | 957 | 1978 | hematopoietic cells | | |
| hsa-miR-377-5p | 958 | 1979 | hematopoietic cells | | |
| hsa-miR-493-3p | 2610 | 3631 | myeloid cells, pancreas (islet) | | |
| hsa-miR-493-5p | 2611 | 3632 | myeloid cells, pancreas (islet) | | |
| hsa-miR-542-3p | 2769 | 3790 | monocytes | | targets to survivin, introduce growth arrest |
| hsa-miR-548b-5p | 2820 | 3841 | immune cells frontal cortex | | |

TABLE 13-continued microRNAs in immune cells

| microRNA | mir SEQ ID | BS SEQ ID | tissues/cells with MicroRNAs | associated diseases | biological functions/targets |
|---|---|---|---|---|---|
| hsa-miR-548c-5p | 2822 | 3843 | immune cells frontal cortex | | |
| hsa-miR-548i | 2831 | 3852 | embryonic stem cells (41), immune cells | | |
| hsa-miR-548j | 2832 | 3853 | immune cells | | |
| hsa-miR-548n | 2836 | 3857 | embryonic stem cells, immune cells | | |
| hsa-miR-574-3p | 2942 | 3963 | blood (myeloid cells) | increased in follicular lymphoma (53) | |
| hsa-miR-598 | 2973 | 3994 | in blood lymphocytes (PBL) | | |
| hsa-miR-935 | 3210 | 4231 | identified in human cervical cancer blood mononuclear cells | associated with energy metabolism/obesity, medullablastoma/ neural stem cells | |
| hsa-miR-99a-3p | 3230 | 4251 | hemapoietic cells | | |
| hsa-miR-99a-5p | 3231 | 4252 | hemapoietic cells, plasma (exosome) | | |
| hsa-miR-99b-3p | 3232 | 4253 | hemapoietic cells, Embryonic stem cells, | | |
| hsa-miR-99b-5p | 3233 | 4254 | hemapoietic cells, Embryonic stem cells, plasma(exosome) | | |

III. Modifications

Herein, in a nucleotide, nucleoside polynucleotide (such as the nucleic acids of the invention, e.g., modified RNA, modified nucleic acid molecule, modified RNAs, nucleic acid and modified nucleic acids), the terms "modification" or, as appropriate, "modified" refer to modification with respect to A, G, U or C ribonucleotides. Generally, herein, these terms are not intended to refer to the ribonucleotide modifications in naturally occurring 5'-terminal mRNA cap moieties. In a polypeptide, the term "modification" refers to a modification as compared to the canonical set of 20 amino acids.

The modifications may be various distinct modifications. In some embodiments, where the nucleic acids or modified RNA, the coding region, the flanking regions and/or the terminal regions may contain one, two, or more (optionally different) nucleoside or nucleotide modifications. In some embodiments, a modified nucleic acids or modified RNA introduced to a cell may exhibit reduced degradation in the cell, as compared to an unmodified nucleic acid or modified RNA.

The polynucleotide, primary construct, nucleic acids or modified RNA can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), e.g., the substitution of the 2'OH of the ribofuranysyl ring to 2'H, threose nucleic acids (TNAs), glycol nucleic acids (GNAs), peptide nucleic acids (PNAs), locked nucleic acids (LNAs) or hybrids thereof). Additional modifications are described herein.

As described herein, the polynucleotides, primary construct, nucleic acids or modified RNA of the invention do not substantially induce an innate immune response of a cell into which the polynucleotides, primary constructs, nucleic acids or modified RNA (e.g., mRNA) is introduced. Features of an induced innate immune response include 1) increased expression of pro-inflammatory cytokines, 2) activation of intracellular PRRs (RIG-I, MDA5, etc, and/or 3) termination or reduction in protein translation.

In certain embodiments, it may desirable for a modified nucleic acid molecule introduced into the cell to be degraded intracellulary. For example, degradation of a modified nucleic acid molecule may be preferable if precise timing of protein production is desired. Thus, in some embodiments, the invention provides a modified nucleic acid molecule containing a degradation domain, which is capable of being acted on in a directed manner within a cell. In another aspect, the present disclosure provides polynucleotides, primary constructs, nucleic acids or modified RNA comprising a nucleoside or nucleotide that can disrupt the binding of a major groove interacting, e.g. binding, partner with the polynucleotides, primary constructs, nucleic acids or modified RNA (e.g., where the modified nucleotide has decreased binding affinity to major groove interacting partner, as compared to an unmodified nucleotide).

The polynucleotides, primary constructs, nucleic acids or modified RNA can optionally include other agents (e.g., RNAi-inducing agents, RNAi agents, siRNAs, shRNAs, miRNAs, antisense RNAs, ribozymes, catalytic DNA, tRNA, RNAs that induce triple helix formation, aptamers, vectors, etc.). In some embodiments, the polynucleotides, primary constructs, nucleic acids or modified RNA may include one or more messenger RNAs (mRNAs) having one or more modified nucleoside or nucleotides (i.e., modified mRNA molecules). Details for these nucleic acids or modified RNA follow.

Modified mRNA Molecules

The polynucleotides, primary constructs, nucleic acids or modified RNA of the invention includes a first region of linked nucleosides encoding a polypeptide of interest, a first flanking region located at the 5' terminus of the first region, and a second flanking region located at the 3' terminus of the first region. The first region of linked nucleosides may be a translatable region.

In some embodiments, the polynucleotide, primary construct, or mmRNA (e.g., the first region, first flanking region, or second flanking region) includes n number of linked nucleosides having any base, sugar, backbone, building block or other structure or formula, including but not limited to those of Formulas I through IX or any substructures thereof as described in International Application PCT/US12/58519 filed Oct. 3, 2012, the contents of which are incorporated herein by reference in their entirety. Such structures include modifications to the sugar, nucleobase, internucleoside linkage, or combinations thereof.

Combinations of chemical modifications include those taught in including but not limited to those described in International Application PCT/US12/58519 filed Oct. 3, 2012, the contents of which are incorporated herein by reference in their entirety.

The synthesis of polynucleotides, primary constructs or mmRNA of the present invention may be according to the methods described in International Application PCT/US12/58519 filed Oct. 3, 2012, the contents of which are incorporated herein by reference in their entirety.

In some embodiments, the nucleobase selected from the group consisting of cytosine, guanine, adenine, and uracil.

In some embodiments, the modified nucleobase is a modified uracil. Exemplary nucleobases and nucleosides having a modified uracil include pseudouridine ($\psi$), pyridin-4-one ribonucleoside, 5-aza-uridine, 6-aza-uridine, 2-thio-5-aza-uridine, 2-thiouridine ($s^2U$), 4-thio-uridine ($s^4U$), 4-thio-pseudouridine, 2-thio-pseudouridine, 5-hydroxyuridine (ho$^5$U), 5-aminoallyl-uridine, 5-halo-uridine (e.g., 5-iodo-uridine or 5-bromo-uridine), 3-methyluridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s$^2$U), 5-aminomethyl-2-thio-uridine (nm$^5$s$^2$U), 5-methylaminomethyl-uridine (mnm$^5$U), 5-methylaminomethyl-2-thio-uridine (mnm$^5$s$^2$U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s$^2$U), 5-propynyl-uridine, 1-propynyl-pseudouridine, 5-taurinomethyluridine ($\tau$m$^5$U), 1-taurinomethyl-pseudouridine, 5-taurinomethyl-2-thio-uridine ($\tau$m$^5$s$^2$U), 1-taurinomethyl-4-thio-pseudouridine, 5-methyl-uridine (m$^5$U, i.e., having the nucleobase deoxythymine), 1-methyl-pseudouridine (m$^1\psi$), 5-methyl-2-thio-uridine (m$^5$s$^2$U), 1-methyl-4-thio-pseudouridine (m$^1$s$^4\psi$), 4-thio-1-methyl-pseudouridine, 3-methyl-pseudouridine (m$^3\psi$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp$^3$U), 1-methyl-3-(3-amino-3-carboxypropyl)pseudouridine (acp$^3\psi$), 5-(isopentenylaminomethyl)uridine (inm$^5$U), 5-(isopentenylaminomethyl)-2-thio-uridine (inm$^5$s$^2$U), α-thio-uridine, 2'-O-methyl-uridine (Um), 5,2'-O-dimethyl-uridine (m$^5$Um), 2'-O-methyl-pseudouridine ($\psi$m), 2-thio-2'-β-methyl-uridine (s$^2$Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), and 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino) uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine (m$^3$C), N4-acetyl-cytidine (ac$^4$C), 5-formylcytidine (f$^5$C), N4-methylcytidine (m$^4$C), 5-methyl-cytidine (m$^5$C), 5-halo-cytidine (e.g., 5-iodo-cytidine), 5-hydroxymethylcytidine (hm$^5$C), 1-methyl-pseudoisocytidine, pyrrolo-cytidine, pyrrolo-pseudoisocytidine, 2-thio-cytidine (s$^2$C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$_2$C), α-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-O-methyl-cytidine (f$^5$Cm), N4,N4,2'-O-trimethyl-cytidine (m$^4_2$Cm), 1-thio-cytidine, 2'-F-ara-cytidine, 2'-F-cytidine, and 2'-OH-ara-cytidine.

In some embodiments, the modified nucleobase is a modified adenine. Exemplary nucleobases and nucleosides having a modified adenine include 2-aminopurine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyladenosine (m$^1$A), 2-methyl-adenine (m$^2$A), N6-methyladenosine (m$^6$A), 2-methylthio-N6-methyl-adenosine (ms$^2$m$^6$A), N6-isopentenyladenosine (i$^6$A), 2-methylthio-N6-isopentenyladenosine (ms$^2$i$^6$A), N6-(cis-hydroxyisopentenyl)adenosine (io$^6$A), 2-methylthio-N6-(cis-hydroxyisopentenyl) adenosine (ms$^2$io$^6$A), N6-glycinylcarbamoyladenosine (g$^6$A), N6-threonylcarbamoyladenosine (t$^6$A), N6-methyl-N6-threonylcarbamoyl-adenosine (m$^6$t$^6$A), 2-methylthio-N6-threonyl carbamoyladenosine (ms$^2$g$^6$A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms²hn⁶A), N6-acetyl-adenosine (ac⁶A), 7-methyladenine, 2-methylthio-adenine, 2-methoxy-adenine, α-thio-adenosine, 2'-β-methyl-adenosine (Am), N6,2'-O-dimethyl-adenosine (m⁶Am), N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

In some embodiments, the modified nucleobase is a modified guanine Exemplary nucleobases and nucleosides having a modified guanine include inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQo), 7-aminomethyl-7-deaza-guanosine (preQi), archaeosine (G⁺), 7-deaza-8-aza-guanosine, 6-thio-guanosine, 6-thio-7-deaza-guanosine, 6-thio-7-deaza-8-aza-guanosine, 7-methylguanosine (m⁷G), 6-thio-7-methyl-guanosine, 7-methyl-inosine, 6-methoxy-guanosine, 1-methylguanosine (m¹G), N2-methyl-guanosine (m²G), N2,N2-dimethyl-guanosine (m²₂G), N2,7-dimethyl-(m²,²,⁷G), guanosine (m²,⁷G), N2,N2,7-dimethyl-guanosine 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m¹Gm), N2,7-dimethyl-2'-O-methyl-guanosine (m²,⁷Gm), 2'-O-methyl-inosine (Im), 1,2'-O-dimethyl-inosine (m'Im), 2'-β-ribosylguanosine (phosphate) (Gr(p)), 1-thio-guanosine, 06-methyl-guanosine, 2'-F-ara-guanosine, and 2'-F-guanosine.

Phosphorothioate DNA and RNA have increased nuclease resistance and subsequently a longer half-life in a cellular environment. Phosphorothioate linked nucleic acids are expected to also reduce the innate immune response through weaker binding/activation of cellular innate immune molecules.

The nucleobase of the nucleotide can be independently selected from a purine, a pyrimidine, a purine or pyrimidine analog. For example, the nucleobase can each be independently selected from adenine, cytosine, guanine, uracil, or hypoxanthine. In another embodiment, the nucleobase can also include, for example, naturally-occurring and synthetic derivatives of a base, including pyrazolo[3,4-d]pyrimidines, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-propynyl uracil and cytosine, 6-azo uracil, cytosine and thymine, 5-uracil (pseudouracil), 4-thiouracil, 8-halo (e.g., 8-bromo), 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, deazaguanine, 7-deazaguanine, 3-deazaguanine, deazaadenine, 7-deazaadenine, 3-deazaadenine, pyrazolo[3,4-d]pyrimidine, imidazo[1,5-a]1,3,5 triazinones, 9-deazapurines, imidazo[4,5-d]pyrazines, thiazolo[4,5-d]pyrimidines, pyrazin-2-ones, 1,2,4-triazine, pyridazine; and 1,3,5 triazine. When the nucleotides are depicted using the shorthand A, G, C, T or U, each letter refers to the representative base and/or derivatives thereof, e.g., A includes adenine or adenine analogs, e.g., 7-deaza adenine).

Modifications on the Internucleoside Linkage

The modified nucleotides, which may be incorporated into a nucleic acid or modified RNA molecule, can be modified on the internucleoside linkage (e.g., phosphate backbone). Herein, in the context of the polynucleotides, primary constructs, nucleic acids or modified RNA backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage as described herein. Examples of modified phosphate groups include, but are not limited to, phosphorothioate, phosphoroselenates, boranophosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates).

The α-thio substituted phosphate moiety is provided to confer stability to RNA and DNA polymers through the unnatural phosphorothioate backbone linkages. Phosphorothioate DNA and RNA have increased nuclease resistance and subsequently a longer half-life in a cellular environment. While not wishing to be bound by theory, phosphorothioate linked polynucleotides, primary constructs, nucleic acids or modified RNA molecules are expected to also reduce the innate immune response through weaker binding/activation of cellular innate immune molecules.

In specific embodiments, a modified nucleoside includes an alpha-thio-nucleoside (e.g., 5'-O-(1-thiophosphate)-adenosine, 5'-O-(1-thiophosphate)-cytidine (α-thio-cytidine), 5'-O-(1-thiophosphate)-guanosine, 5'-O-(1-thiophosphate)-uridine, or 5'-O-(1-thiophosphate)-pseudouridine).

Other internucleoside linkages that may be employed according to the present invention, including internucleoside linkages which do not contain a phosphorous atom, are described herein below.

Combinations of Modified Sugars, Nucleobases, and Internucleoside Linkages

The nucleic acids or modified RNA of the invention can include a combination of modifications to the sugar, the nucleobase, and/or the internucleoside linkage. These combinations can include any one or more modifications described herein. For examples, any of the nucleotides described herein in Formulas (Ia), (Ia-1)-(Ia-3), (Ib)-(If), (IIa)-(IIp), (IIb-1), (IIb-2), (IIc-1)-(IIc-2), (IIn-1), (IIn-2), (IVa)-(IVl), and (IXa)-(IXr) can be combined with any of the nucleobases described herein (e.g., in Formulas (b1)-(b43) or any other described herein).

Synthesis of Nucleic Acids or Modified RNA Molecules (Modified RNAs)

Nucleic acids for use in accordance with the invention may be prepared according to any useful technique as described herein or any available technique including, but not limited to chemical synthesis, enzymatic synthesis, which is generally termed in vitro transcription, enzymatic or chemical cleavage of a longer precursor, etc. Methods of synthesizing RNAs are known in the art (see, e.g., Gait, M. J. (ed.) *Oligonucleotide synthesis: a practical approach*, Oxford [Oxfordshire], Washington, D.C.: IRL Press, 1984; and Herdewijn, P. (ed.) *Oligonucleotide synthesis: methods and applications*, Methods in Molecular Biology, v. 288 (Clifton, N.J.) Totowa, N.J.: Humana Press, 2005; both of which are incorporated herein by reference).

The modified nucleosides and nucleotides used in the synthesis of modified RNAs disclosed herein can be prepared from readily available starting materials using the following general methods and procedures. It is understood that where typical or preferred process conditions (i.e., reaction temperatures, times, mole ratios of reactants, solvents, pressures, etc.) are given; other process conditions can also be used unless otherwise stated. Optimum reaction conditions may vary with the particular reactants or solvent used, but such conditions can be determined by one skilled in the art by routine optimization procedures.

The processes described herein can be monitored according to any suitable method known in the art. For example, product formation can be monitored by spectroscopic means, such as nuclear magnetic resonance spectroscopy (e.g., $^1$H or $^{13}$C) infrared spectroscopy, spectrophotometry (e.g., UV-visible), or mass spectrometry, or by chromatography such as high performance liquid chromatography (HPLC) or thin layer chromatography.

Preparation of modified nucleosides and nucleotides used in the manufacture or synthesis of modified RNAs of the present invention can involve the protection and deprotection of various chemical groups. The need for protection and deprotection, and the selection of appropriate protecting groups can be readily determined by one skilled in the art. The chemistry of protecting groups can be found, for example, in Greene, et al., *Protective Groups in Organic Synthesis*, 2d. Ed., Wiley & Sons, 1991, which is incorporated herein by reference in its entirety.

The reactions of the processes described herein can be carried out in suitable solvents, which can be readily selected by one of skill in the art of organic synthesis. Suitable solvents can be substantially nonreactive with the starting materials (reactants), the intermediates, or products at the temperatures at which the reactions are carried out, i.e., temperatures which can range from the solvent's freezing temperature to the solvent's boiling temperature. A given reaction can be carried out in one solvent or a mixture of more than one solvent. Depending on the particular reaction step, suitable solvents for a particular reaction step can be selected.

Resolution of racemic mixtures of modified nucleosides and nucleotides can be carried out by any of numerous methods known in the art. An example method includes fractional recrystallization using a "chiral resolving acid" which is an optically active, salt-forming organic acid. Suitable resolving agents for fractional recrystallization methods are, for example, optically active acids, such as the D and L forms of tartaric acid, diacetyltartaric acid, dibenzoyltartaric acid, mandelic acid, malic acid, lactic acid or the various optically active camphorsulfonic acids. Resolution of racemic mixtures can also be carried out by elution on a column packed with an optically active resolving agent (e.g., dinitrobenzoylphenylglycine). Suitable elution solvent composition can be determined by one skilled in the art.

Modified nucleosides and nucleotides (e.g., building block molecules) can be prepared according to the synthetic methods described in Ogata et al., J. Org. Chem. 74:2585-2588 (2009); Purmal et al., Nucl. Acids Res. 22(1): 72-78, (1994); Fukuhara et al., Biochemistry, 1(4): 563-568 (1962); and Xu et al., Tetrahedron, 48(9): 1729-1740 (1992), each of which are incorporated by reference in their entirety.

Modified nucleosides and nucleotides (e.g., building block molecules) can be prepared according to the synthetic methods described in Ogata et al., J. Org. Chem. 74:2585-2588 (2009); Purmal et al., Nucl. Acids Res. 22(1): 72-78, (1994); Fukuhara et al., Biochemistry, 1(4): 563-568 (1962); and Xu et al., Tetrahedron, 48(9): 1729-1740 (1992), each of which are incorporated by reference in their entirety.

The modified nucleic acids of the invention may or may not be uniformly modified along the entire length of the molecule. Different nucleotide modifications and/or backbone structures may exist at various positions in the nucleic acid. One of ordinary skill in the art will appreciate that the nucleotide analogs or other modification(s) may be located at any position(s) of a nucleic acid such that the function of the nucleic acid is not substantially decreased. A modification may also be a 5' or 3' terminal modification. The nucleic acids may contain at a minimum one and at maximum 100% modified nucleotides, or any intervening percentage, such as at least 50% modified nucleotides, at least 80% modified nucleotides, or at least 90% modified nucleotides. For example, one or more or all types of nucleotide (e.g., purine or pyrimidine, or any one or more or all of A, G, U, C) may or may not be uniformly modified in a nucleic acids or modified RNA of the invention, or in a given predetermined sequence region thereof. In some embodiments, all nucleotides X in a nucleic acids or modified RNA of the invention (or in a given sequence region thereof) are modified, wherein X may any one of nucleotides A, G, U, C, or any one of the combinations A+G, A+U, A+C, G+U, G+C, U+C, A+G+U, A+G+C, G+U+C or A+G+C.

Different sugar modifications, nucleotide modifications, and/or internucleoside linkages (e.g., backbone structures) may exist at various positions in the nucleic acids or modified RNA. One of ordinary skill in the art will appreciate that the nucleotide analogs or other modification(s) may be located at any position(s) of a nucleic acid or modified RNA such that the function of the nucleic acids or modified RNA is not substantially decreased. A modification may also be a 5' or 3' terminal modification. The nucleic acids or modified RNA may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, the nucleic acids or modified RNA includes a modified pyrimidine (e.g., a modified uracil/uridine/U or modified cytosine/cytidine/C). In some embodiments, the uracil or uridine (generally: U) in the nucleic acids or modified RNA molecule may be replaced with from about 1% to about 100% of a modified uracil or modified uridine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified uracil or modified uridine). The modified uracil or uridine can be replaced by a compound having a single unique structure or by a plurality of compounds having different structures (e.g., 2, 3, 4 or more unique structures, as described herein). In some embodiments, the cytosine or cytidine (generally: C) in the nucleic acid or modified RNA molecule may be replaced with from about 1% to about 100% of a modified cytosine or modified cytidine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified cytosine or modified cytidine). The modified cytosine or cytidine can be replaced by a compound having a single unique structure or by a plurality of compounds having different structures (e.g., 2, 3, 4 or more unique structures, as described herein).

Other components of the nucleic acid are optional, and are beneficial in some embodiments. For example, a 5' untranslated region (UTR) and/or a 3'UTR are provided, wherein either or both may independently contain one or more different nucleotide modifications. In such embodiments, nucleotide modifications may also be present in the translatable region. Also provided are nucleic acids containing a Kozak sequence which may include an IRES sequence or not include an IRES sequence (See e.g., the polynucleotides described in Table 30 in Example 31).

Additionally, provided are nucleic acids containing one or more intronic nucleotide sequences capable of being excised from the nucleic acid.

Combinations of Nucleotides

Further examples of modified nucleotides and modified nucleotide combinations are provided below in Table 14. These combinations of modified nucleotides can be used to form the nucleic acids or modified RNA of the invention. Unless otherwise noted, the modified nucleotides may be completely substituted for the natural nucleotides of the nucleic acids or modified RNA of the invention. As a non-limiting example, the natural nucleotide uridine may be substituted with a modified nucleoside described herein. In another non-limiting example, the natural nucleotide uridine may be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein.

TABLE 14

Chemical Modifications

| Modified Nucleotide | Modified Nucleotide Combination |
| --- | --- |
| 6-aza-cytidine | α-thio-cytidine/5-iodo-uridine |
| 2-thio-cytidine | α-thio-cytidine/N1-methyl-pseudo-uridine |
| α-thio-cytidine | α-thio-cytidine/α-thio-uridine |
| Pseudo-iso-cytidine | α-thio-cytidine/5-methyl-uridine |
| 5-aminoallyl-uridine | α-thio-cytidine/pseudo-uridine |
| 5-iodo-uridine | Pseudo-iso-cytidine/5-iodo-uridine |
| N1-methyl-pseudouridine | Pseudo-iso-cytidine/N1-methyl-pseudo-uridine |
| 5,6-dihydrouridine | Pseudo-iso-cytidine/α-thio-uridine |
| α-thio-uridine | Pseudo-iso-cytidine/5-methyl-uridine |
| 4-thio-uridine | Pseudo-iso-cytidine/Pseudo-uridine |
| 6-aza-uridine | |
| 5-hydroxy-uridine | Pyrrolo-cytidine/5-iodo-uridine |
| Deoxy-thymidine | Pyrrolo-cytidine/N1-methyl-pseudo-uridine |
| Pseudo-uridine | Pyrrolo-cytidine/α-thio-uridine |
| Inosine | Pyrrolo-cytidine/5-methyl-uridine |
| α-thio-guanosine | Pyrrolo-cytidine/Pseudo-uridine |
| 8-oxo-guanosine | 5-methyl-cytidine/5-iodo-uridine |
| O6-methyl-guanosine | 5-methyl-cytidine/N1-methyl-pseudo-uridine |
| 7-deaza-guanosine | 5-methyl-cytidine/α-thio-uridine |
| No modification | 5-methyl-cytidine/5-methyl-uridine |
| N1-methyl-adenosine | 5-methyl-cytidine/Pseudo-uridine |
| 2-amino-6-Chloro-purine | |
| N6-methyl-2-amino-purine | about 25% of cytosines are Pseudo-iso-cytidine |
| 6-Chloro-purine | about 25% of uridines are N1-methyl-pseudo-uridine |
| N6-methyl-adenosine | 25% N1-Methyl-pseudo-uridine/75%-pseudo-uridine |
| α-thio-adenosine | |
| 8-azido-adenosine | |
| 7-deaza-adenosine | about 50% of the cytosines are pyrrolo-cytidine |
| Pyrrolo-cytidine | 5-methyl-cytidine/5-iodo-uridine |
| 5-methyl-cytidine | 5-methyl-cytidine/N1-methyl-pseudouridine |
| N4-acetyl-cytidine | 5-methyl-cytidine/α-thio-uridine |
| 5-methyl-uridine | 5-methyl-cytidine/5-methyl-uridine |
| 5-iodo-cytidine | 5-methyl-cytidine/pseudouridine |

TABLE 14-continued

Chemical Modifications

| Modified Nucleotide | Modified Nucleotide Combination |
|---|---|
| | about 25% of cytosines are 5-methyl-cytidine
about 50% of cytosines are 5-methyl-cytidine
5-methyl-cytidine/5-methoxy-uridine
5-methyl-cytidine/5-bromo-uridine
5-methyl-cytidine/2-thio-uridine
5-methyl-cytidine/about 50% of uridines are 2-thio-uridine
about 50% of uridines are 5-methyl-cytidine/about 50% of uridines are 2-thio-uridine
N4-acetyl-cytidine/5-iodo-uridine
N4-acetyl-cytidine/N1-methyl-pseudouridine
N4-acetyl-cytidine/α-thio-uridine
N4-acetyl-cytidine/5-methyl-uridine
N4-acetyl-cytidine/pseudouridine
about 50% of cytosines are N4-acetyl-cytidine
about 25% of cytosines are N4-acetyl-cytidine
N4-acetyl-cytidine/5-methoxy-uridine
N4-acetyl-cytidine/5-bromo-uridine
N4-acetyl-cytidine/2-thio-uridine
about 50% of cytosines are N4-acetyl-cytidine/about 50% of uridines are 2-thio-uridine
pseudoisocytidine/about 50% of uridines are N1-methyl-pseudouridine and about 50% of uridines are pseudouridine
pseudoisocytidine/about 25% of uridines are N1-methyl-pseudouridine and about 25% of uridines are pseudouridine (e.g., 25% N1-methyl-pseudouridine/75% pseudouridine)
about 50% of the cytosines are α-thio-cytidine |

Certain modified nucleotides and nucleotide combinations have been explored by the current inventors. These findings are described in U.S. Provisional Application No. 61/404,413, filed on Oct. 1, 2010, entitled Engineered Nucleic Acids and Methods of Use Thereof, U.S. patent application Ser. No. 13/251,840, filed on Oct. 3, 2011, entitled Modified Nucleotides, and Nucleic Acids, and Uses Thereof, now abandoned, U.S. patent application Ser. No. 13/481,127, filed on May 25, 2012, entitled Modified Nucleotides, and Nucleic Acids, and Uses Thereof, International Patent Publication No WO2012045075, filed on Oct. 3, 2011, entitled Modified Nucleosides, Nucleotides, And Nucleic Acids, and Uses Thereof, U.S. Patent Publication No US20120237975 filed on Oct. 3, 2011, entitled Engineered Nucleic Acids and Method of Use Thereof, and International Patent Publication No WO2012045082, which are incorporated by reference in their entireties.

Further examples of modified nucleotide combinations are provided below in Table 15. These combinations of modified nucleotides can be used to form the nucleic acids of the invention.

TABLE 15

Chemical Modifications

| Modified Nucleotide | Modified Nucleotide Combination |
|---|---|
| modified cytidine having one or more nucleobases of Formula (b10) | modified cytidine with (b10)/pseudouridine
modified cytidine with (b10)/N1-methyl-pseudouridine
modified cytidine with (b10)/5-methoxy-uridine
modified cytidine with (b10)/5-methyl-uridine
modified cytidine with (b10)/5-bromo-uridine
modified cytidine with (b10)/2-thio-uridine
about 50% of cytidine substituted with modified cytidine (b10)/about 50% of uridines are 2-thio-uridine |
| modified cytidine having one or more nucleobases of Formula (b32) | modified cytidine with (b32)/pseudouridine
modified cytidine with (b32)/N1-methyl-pseudouridine
modified cytidine with (b32)/5-methoxy-uridine
modified cytidine with (b32)/5-methyl-uridine
modified cytidine with (b32)/5-bromo-uridine
modified cytidine with (b32)/2-thio-uridine
about 50% of cytidine substituted with modified cytidine (b32)/about 50% of uridines are 2-thio-uridine |
| modified uridine having one or more nucleobases of Formula (b1) | modified uridine with (b1)/N4-acetyl-cytidine
modified uridine with (b1)/5-methyl-cytidine |

TABLE 15-continued

Chemical Modifications

| Modified Nucleotide | Modified Nucleotide Combination |
|---|---|
| modified uridine having one or more nucleobases of Formula (b8) | modified uridine with (b8)/N4-acetyl-cytidine |
| | modified uridine with (b8)/5-methyl-cytidine |
| modified uridine having one or more nucleobases of Formula (b28) | modified uridine with (b28)/N4-acetyl-cytidine |
| | modified uridine with (b28)/5-methyl-cytidine |
| modified uridine having one or more nucleobases of Formula (b29) | modified uridine with (b29)/N4-acetyl-cytidine |
| | modified uridine with (b29)/5-methyl-cytidine |
| modified uridine having one or more nucleobases of Formula (b30) | modified uridine with (b30)/N4-acetyl-cytidine |
| | modified uridine with (b30)/5-methyl-cytidine |

In some embodiments, at least 25% of the cytosines are replaced by a compound of Formula (b10)-(b14), (b24), (b25), or (b32)-(b35) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100% of, e.g., a compound of Formula (b10) or (b32)).

In some embodiments, at least 25% of the uracils are replaced by a compound of Formula (b1)-(b9), (b21)-(b23), or (b28)-(b31) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100% of, e.g., a compound of Formula (b1), (b8), (b28), (b29), or (b30)).

In some embodiments, at least 25% of the cytosines are replaced by a compound of Formula (b10)-(b14), (b24), (b25), or (b32)-(b35) (e.g. Formula (b10) or (b32)), and at least 25% of the uracils are replaced by a compound of Formula (b1)-(b9), (b21)-(b23), or (b28)-(b31) (e.g. Formula (b1), (b8), (b28), (b29), or (b30)) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

Modifications Including Linker and a Payload

Payload

The methods and compositions described herein are useful for delivering a payload to a biological target. The payload can be used, e.g., for labeling (e.g., a detectable agent such as a fluorophore), or for therapeutic purposes (e.g., a cytotoxin or other therapeutic agent).

Payload: Therapeutic Agents

In some embodiments the payload is a therapeutic agent such as a cytotoxin, radioactive ion, chemotherapeutic, or other therapeutic agent. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, puromycin, may- tansinoids, e.g., maytansinol (see U.S. Pat. No. 5,208,020), CC-1065 (see U.S. Pat. Nos. 5,475,092, 5,585,499, 5,846, 545) and analogs or homologs thereof. Radioactive ions include, but are not limited to iodine (e.g., iodine 125 or iodine 131), strontium 89, phosphorous, palladium, cesium, iridium, phosphate, cobalt, yttrium 90, Samarium 153 and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, CC-1065, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

Payload: Detectable Agents

Examples of detectable substances include various organic small molecules, inorganic compounds, nanoparticles, enzymes or enzyme substrates, fluorescent materials, luminescent materials, bioluminescent materials, chemiluminescent materials, radioactive materials, and contrast agents. Such optically-detectable labels include for example, without limitation, 4-acetamido-4'-isothiocyanatostilbene-2, 2'disulfonic acid; acridine and derivatives: acridine, acridine isothiocyanate; 5-(2'-aminoethyl)aminonaphthalene-1-sulfonic acid (EDANS); 4-amino-N-[3-vinylsulfonyl)phenyl] naphthalimide-3,5 disulfonate; N-(4-anilino-1-naphthyl)maleimide; anthranilamide; BODIPY; Brilliant Yellow; coumarin and derivatives; coumarin, 7-amino-4-methylcoumarin (AMC, Coumarin 120), 7-amino-4-trifluoromethylcouluarin (Coumaran 151); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]naphthalene-1-sulfonyl chloride (DNS, dansylchloride); 4-dimethylaminophenylazophenyl-4'-isothiocyanate (DABITC); eosin and derivatives; eosin, eosin isothiocyanate, erythrosin and derivatives; erythrosin B, erythrosin, isothiocyanate; ethidium; fluorescein and derivatives; 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, QFITC, (XRITC); fluorescamine; IR144; IR1446; Malachite Green isothiocyanate; 4-methylumbelliferoneortho cresolphthalein; nitrotyrosine; pararosaniline; Phenol Red; B-phycoerythrin; o-phthaldialdehyde; pyrene and derivatives: pyrene, pyrene butyrate, succinimidyl 1-pyrene; butyrate quantum dots; Reactive Red 4 (Cibacron™ Brilliant Red 3B-A) rhodamine and derivatives: 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red); N,N,N',N' tetramethyl-6-carboxyrhodamine (TAMRA); tetramethyl rhodamine; tetramethyl rhodamine isothiocyanate (TRITC); riboflavin; rosolic acid; terbium chelate derivatives; Cyanine-3 (Cy3); Cyanine-5 (Cy5); Cyanine-5.5 (Cy5.5), Cyanine-7 (Cy7); IRD 700; IRD 800; Alexa 647; La Jolta Blue; phthalo cyanine; and naphthalo cyanine. In some embodiments, the detectable label is a fluorescent dye, such as Cy5 and Cy3.

Examples luminescent material includes luminol; examples of bioluminescent materials include luciferase, luciferin, and aequorin.

Examples of suitable radioactive material include $^{18}$F, $^{67}$Ga, $^{81m}$KR, $^{82}$Rb, $^{111}$In, $^{123}$I, $^{133}$Xe, $^{201}$Tl, $^{125}$I, $^{35}$S, $^{14}$C, or $^{3}$H, $^{99m}$Tc (e.g., as pertechnetate (technetate(VII), TcO$_4^-$) either directly or indirectly, or other radioisotope detectable by direct counting of radioemission or by scintillation counting.

In addition, contrast agents, e.g., contrast agents for MRI or NMR, for X-ray CT, Raman imaging, optical coherence tomography, absorption imaging, ultrasound imaging, or thermal imaging can be used. Exemplary contrast agents include gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexyl), microbubbles, or perfluorocarbons can also be used.

In some embodiments, the detectable agent is a non-detectable pre-cursor that becomes detectable upon activation. Examples include fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE (VisEn Medical)).

When the compounds are enzymatically labeled with, for example, horseradish peroxidase, alkaline phosphatase, or luciferase, the enzymatic label is detected by determination of conversion of an appropriate substrate to product.

In vitro assays in which these compositions can be used include enzyme linked immunosorbent assays (ELISAs), immunoprecipitations, immunofluorescence, enzyme immunoassay (EIA), radioimmunoassay (RIA), and Western blot analysis.

Labels other than those described herein are contemplated by the present disclosure, including other optically-detectable labels. Labels can be attached to the modified nucleotide of the present disclosure at any position using standard chemistries such that the label can be removed from the incorporated base upon cleavage of the cleavable linker.

Payload: Cell Penetrating Payloads

In some embodiments, the modified nucleotides and modified nucleic acids can also include a payload that can be a cell penetrating moiety or agent that enhances intracellular delivery of the compositions. For example, the compositions can include a cell-penetrating peptide sequence that facilitates delivery to the intracellular space, e.g., HIV-derived TAT peptide, penetratins, transportans, or hCT derived cell-penetrating peptides, see, e.g., Caron et al., (2001) Mol Ther. 3(3):310-8; Langel, Cell-Penetrating Peptides: Processes and Applications (CRC Press, Boca Raton Fla. 2002); El-Andaloussi et al., (2005) Curr Pharm Des. 11(28):3597-611; and Deshayes et al., (2005) Cell Mol Life Sci. 62(16):1839-49. The compositions can also be formulated to include a cell penetrating agent, e.g., liposomes, which enhance delivery of the compositions to the intracellular space.

Payload: Biological Targets

The modified nucleotides and modified nucleic acids described herein can be used to deliver a payload to any biological target for which a specific ligand exists or can be generated. The ligand can bind to the biological target either covalently or non-covalently.

Exemplary biological targets include biopolymers, e.g., antibodies, nucleic acids such as RNA and DNA, proteins, enzymes; exemplary proteins include enzymes, receptors, and ion channels. In some embodiments the target is a tissue- or cell-type specific marker, e.g., a protein that is expressed specifically on a selected tissue or cell type. In some embodiments, the target is a receptor, such as, but not limited to, plasma membrane receptors and nuclear receptors; more specific examples include G-protein-coupled receptors, cell pore proteins, transporter proteins, surface-expressed antibodies, HLA proteins, MHC proteins and growth factor receptors.

Synthesis of Modified Nucleotides

The modified nucleosides and nucleotides disclosed herein can be prepared from readily available starting materials using the following general methods and procedures. It is understood that where typical or preferred process conditions (i.e., reaction temperatures, times, mole ratios of reactants, solvents, pressures, etc.) are given; other process conditions can also be used unless otherwise stated. Optimum reaction conditions may vary with the particular reactants or solvent used, but such conditions can be determined by one skilled in the art by routine optimization procedures.

The processes described herein can be monitored according to any suitable method known in the art. For example, product formation can be monitored by spectroscopic means, such as nuclear magnetic resonance spectroscopy (e.g., $^1$H or $^{13}$C) infrared spectroscopy, spectrophotometry (e.g., UV-visible), or mass spectrometry, or by chromatography such as high performance liquid chromatography (HPLC) or thin layer chromatography.

Preparation of modified nucleosides and nucleotides can involve the protection and deprotection of various chemical groups. The need for protection and deprotection, and the selection of appropriate protecting groups can be readily determined by one skilled in the art. The chemistry of protecting groups can be found, for example, in Greene, et al., *Protective Groups in Organic Synthesis,* 2d. Ed., Wiley & Sons, 1991, which is incorporated herein by reference in its entirety.

The reactions of the processes described herein can be carried out in suitable solvents, which can be readily selected by one of skill in the art of organic synthesis. Suitable solvents can be substantially nonreactive with the starting materials (reactants), the intermediates, or products at the temperatures at which the reactions are carried out, i.e., temperatures which can range from the solvent's freezing temperature to the solvent's boiling temperature. A given reaction can be carried out in one solvent or a mixture of more than one solvent. Depending on the particular reaction step, suitable solvents for a particular reaction step can be selected.

Resolution of racemic mixtures of modified nucleosides and nucleotides can be carried out by any of numerous methods known in the art. An example method includes fractional recrystallization using a "chiral resolving acid" which is an optically active, salt-forming organic acid. Suitable resolving agents for fractional recrystallization methods are, for example, optically active acids, such as the D and L forms of tartaric acid, diacetyltartaric acid, dibenzoyltartaric acid, mandelic acid, malic acid, lactic acid or the various optically active camphorsulfonic acids. Resolution of racemic mixtures can also be carried out by elution on a column packed with an optically active resolving agent (e.g., dinitrobenzoylphenylglycine). Suitable elution solvent composition can be determined by one skilled in the art.

Length

Generally, the length of a modified mRNA of the present invention is greater than 30 nucleotides in length. In another embodiment, the RNA molecule is greater than 35 nucleotides in length. In another embodiment, the length is at least 40 nucleotides. In another embodiment, the length is at least 45 nucleotides. In another embodiment, the length is at least 55 nucleotides. In another embodiment, the length is at least 60 nucleotides. In another embodiment, the length is at least 60 nucleotides. In another embodiment, the length is at least 80 nucleotides. In another embodiment, the length is at least 90 nucleotides. In another embodiment, the length is at least 100 nucleotides. In another embodiment, the length is at least 120 nucleotides. In another embodiment, the length is at least 140 nucleotides. In another embodiment, the length is at least 160 nucleotides. In another embodiment, the length is at least 180 nucleotides. In another embodiment, the length is at least 200 nucleotides. In another embodiment, the length is at least 250 nucleotides. In another embodiment, the length is at least 300 nucleotides. In another embodiment, the length is at least 350 nucleotides. In another embodiment, the length is at least 400 nucleotides. In another embodiment, the length is at least 450 nucleotides. In another embodiment, the length is at least 500 nucleotides. In another embodiment, the length is at least 600 nucleotides. In another embodiment, the length is at least 700 nucleotides. In another embodiment, the length is at least 800 nucleotides. In another embodiment, the length is at least 900 nucleotides. In another embodiment, the length is at least 1000 nucleotides. In another embodiment, the length is at least 1100 nucleotides. In another embodiment, the length is at least 1200 nucleotides. In another embodiment, the length is at least 1300 nucleotides. In another embodiment, the length is at least 1400 nucleotides. In another embodiment, the length is at least 1500 nucleotides. In another embodiment, the length is at least 1600 nucleotides. In another embodiment, the length is at least 1800 nucleotides. In another embodiment, the length is at least 2000 nucleotides. In another embodiment, the length is at least 2500 nucleotides. In another embodiment, the length is at least 3000 nucleotides. In another embodiment, the length is at least 4000 nucleotides. In another embodiment, the length is at least 5000 nucleotides, or greater than 5000 nucleotides. In another embodiment, the length is at least 5000 nucleotides, or greater than 6000 nucleotides. In another embodiment, the length is at least 7000 nucleotides, or greater than 7000 nucleotides. In another embodiment, the length is at least 8000 nucleotides, or greater than 8000 nucleotides. In another embodiment, the length is at least 9000 nucleotides, or greater than 9000 nucleotides. In another embodiment, the length is at least 10,000 nucleotides, or greater than 10,000 nucleotides.

Use of Modified RNAs

Prevention or Reduction of Innate Cellular Immune Response Activation

The term "innate immune response" includes a cellular response to exogenous single stranded nucleic acids, generally of viral or bacterial origin, which involves the induction of cytokine expression and release, particularly the interferons, and cell death. Protein synthesis is also reduced during the innate cellular immune response. While it is advantageous to eliminate the innate immune response in a cell, the invention provides modified mRNAs that substantially reduce the immune response, including interferon signaling, without entirely eliminating such a response. In some embodiments, the immune response is reduced by 10%, 20%, 30%, 40%, 50%, 60%, 70%, 80%, 90%, 95%, 99%, 99.9%, or greater than 99.9% as compared to the immune response induced by a corresponding unmodified nucleic acid. Such a reduction can be measured by expression or activity level of Type 1 interferons or the expression of interferon-regulated genes such as the toll-like receptors (e.g., TLR7 and TLR8). Reduction of innate immune response can also be measured by decreased cell death following one or more administrations of modified RNAs to a cell population; e.g., cell death is 10%, 25%, 50%, 75%, 85%, 90%, 95%, or over 95% less than the cell death frequency observed with a corresponding unmodified nucleic acid. Moreover, cell death may affect fewer than 50%, 40%, 30%, 20%, 10%, 5%, 1%, 0.1%, 0.01% or fewer than 0.01% of cells contacted with the modified nucleic acids.

The invention provides for the repeated introduction (e.g., transfection) of modified nucleic acids into a target cell population, e.g., in vitro, ex vivo, or in vivo. The step of contacting the cell population may be repeated one or more times (such as two, three, four, five or more than five times). In some embodiments, the step of contacting the cell population with the modified nucleic acids is repeated a number of times sufficient such that a predetermined efficiency of protein translation in the cell population is achieved. Given the reduced cytotoxicity of the target cell population provided by the nucleic acid modifications, such repeated transfections are achievable in a diverse array of cell types.

Major Groove Interacting Partners

As described herein, the phrase "major groove interacting partner" refers to RNA recognition receptors that detect and respond to RNA ligands through interactions, e.g. binding, with the major groove face of a nucleotide or nucleic acid. As such, RNA ligands comprising modified nucleotides or nucleic acids such as the modified RNAs as described herein decrease interactions with major groove binding partners, and therefore decrease an innate immune response.

Example major groove interacting, e.g. binding, partners include, but are not limited to the following nucleases and helicases. Within membranes, TLRs (Toll-like Receptors) 3, 7, and 8 can respond to single- and double-stranded RNAs. Within the cytoplasm, members of the superfamily 2 class of DEX(D/H) helicases and ATPases can sense RNAs to initiate antiviral responses. These helicases include the RIG-I (retinoic acid-inducible gene I) and MDA5 (melanoma differentiation-associated gene 5). Other examples include laboratory of genetics and physiology 2 (LGP2), HIN-200 domain containing proteins, or Helicase-domain containing proteins.

RNA Binding Proteins

In some embodiments of the present invention, RNA binding proteins are provided. RNA binding proteins may be provided as proteins and/or as nucleic acids encoding such proteins. RNA binding proteins play a multitude of roles in regulating RNA stability and protein translation. A/U rich elements in the 3' UTR of mRNAs leads to formation of secondary structures which are bound by A/U Rich Binding Proteins (AREBPs) resulting in increased or decreased mRNA stability (Fan, X. C. et al., Overexpression of HuR, a nuclear-cytoplasmic shuttling protein, increases the in vivo stability of ARE-containing mRNAs. EMBO J. 1998 Jun. 15; 17(12):3448-60). HuR is a stabilizing AREBP. To increase the stability of the mRNA of interest, an mRNA encoding HuR can be co-transfected or co-injected along with the mRNA of interest into the cells or into the tissue. These proteins can also be tethered to the mRNA of interest in vitro and then administered to the cells together. Poly A tail binding protein, PABP interacts with eukaryotic translation initiation factor eIF4G to stimulate translational initiation. Co-administration of mRNAs encoding these RBPs along with the mRNA drug and/or tethering these proteins to the mRNA drug in vitro and administering the protein-bound mRNA into the cells can increase the translational efficiency of the mRNA. The same concept can be extended to co-administration of mRNA along with mRNAs encoding various translation factors and facilitators as well as with the proteins themselves to influence RNA stability and/or translational efficiency.

Polypeptide Variants

Provided are nucleic acids that encode variant polypeptides, which have a certain identity with a reference polypeptide sequence. The term "identity" as known in the art, refers to a relationship between the sequences of two or more peptides, as determined by comparing the sequences. In the art, "identity" also means the degree of sequence relatedness between peptides, as determined by the number of matches between strings of two or more amino acid residues.

"Identity" measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the polypeptide variant has the same or a similar activity as the reference polypeptide. Alternatively, the variant has an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular reference polynucleotide or polypeptide as determined by sequence alignment programs and parameters described herein and known to those skilled in the art.

As recognized by those skilled in the art, protein fragments, functional protein domains, and homologous proteins are also considered to be within the scope of this invention. For example, provided herein is any protein fragment of a reference protein (meaning a polypeptide sequence at least one amino acid residue shorter than a reference polypeptide sequence but otherwise identical) 10, 20, 30, 40, 50, 60, 70, 80, 90, 100 or greater than 100 amino acids in length In another example, any protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a protein sequence to be utilized in accordance with the invention includes 2, 3, 4, 5, 6, 7, 8, 9, 10, or more mutations as shown in any of the sequences provided or referenced herein.

Polypeptide Libraries

Also provided are polynucleotide libraries containing nucleoside modifications, wherein the polynucleotides individually contain a first nucleic acid sequence encoding a polypeptide, such as an antibody, protein binding partner, scaffold protein, and other polypeptides known in the art. Preferably, the polynucleotides are mRNA in a form suitable for direct introduction into a target cell host, which in turn synthesizes the encoded polypeptide.

In certain embodiments, multiple variants of a protein, each with different amino acid modification(s), are produced and tested to determine the best variant in terms of pharmacokinetics, stability, biocompatibility, and/or biological activity, or a biophysical property such as expression level. Such a library may contain 10, $10^2$, $10^3$, $10^4$, $10^5$, $10^6$, $10^7$, $10^8$, $10^9$, or over $10^9$ possible variants (including substitutions, deletions of one or more residues, and insertion of one or more residues).

Polypeptide-Nucleic Acid Complexes

Proper protein translation involves the physical aggregation of a number of polypeptides and nucleic acids associated with the mRNA. Provided by the invention are complexes containing conjugates of protein and nucleic acids, containing a translatable mRNA having one or more nucleoside modifications (e.g., at least two different nucleoside modifications) and one or more polypeptides bound to the mRNA. Generally, the proteins are provided in an amount effective to prevent or reduce an innate immune response of a cell into which the complex is introduced.

Targeting Moieties

In embodiments of the invention, modified nucleic acids are provided to express a protein-binding partner or a receptor on the surface of the cell, which functions to target the cell to a specific tissue space or to interact with a specific moiety, either in vivo or in vitro. Suitable protein-binding partners include antibodies and functional fragments thereof, scaffold proteins, or peptides. Additionally, modified nucleic acids can be employed to direct the synthesis and extracellular localization of lipids, carbohydrates, or other biological moieties.

As described herein, a useful feature of the modified nucleic acids of the invention is the capacity to reduce the innate immune response of a cell to an exogenous nucleic acid. Provided are methods for performing the titration, reduction or elimination of the immune response in a cell or a population of cells. In some embodiments, the cell is contacted with a first composition that contains a first dose of a first exogenous nucleic acid including a translatable region and at least one nucleoside modification, and the level of the innate immune response of the cell to the first exogenous nucleic acid is determined. Subsequently, the cell is contacted with a second composition, which includes a second dose of the first exogenous nucleic acid, the second dose containing a lesser amount of the first exogenous nucleic acid as compared to the first dose.

Alternatively, the cell is contacted with a first dose of a second exogenous nucleic acid. The second exogenous nucleic acid may contain one or more modified nucleosides, which may be the same or different from the first exogenous nucleic acid or, alternatively, the second exogenous nucleic acid may not contain modified nucleosides. The steps of contacting the cell with the first composition and/or the second composition may be repeated one or more times.

Additionally, efficiency of protein production (e.g., protein translation) in the cell is optionally determined, and the cell may be re-transfected with the first and/or second composition repeatedly until a target protein production efficiency is achieved.

In one embodiment, the 3' end of the modified nucleic acids described herein may include a sequence for targeting the modified nucleic acid to a desired location within the cell such as, but not limited to, microvesicles within a cell. The sequence for targeting may be "zip code-like" in its function as it can be recognized by the cellular machinery that can traffic molecules to various places within the cell. Non-limiting examples of sequences for targeting nucleic acids are described in International Patent Publication No. WO2013109713, the contents of which are herein incorporated by reference in its entirety. Zip-code like sequences and miR-1289 have been shown by Bolukbasi et al. to enrich mRNA in microvesicles (Mol. Ther. Nuc. Acid 2012 1, e10; the contents of which are herein incorporated by reference in its entirety) as both zipcodes and microRNA have a role in post-transcriptional regulation of mRNA.

In one embodiment, the sequence for targeting the modified nucleic acid is SEQ ID NO: 22, SEQ ID NO: 38 or a concatomer of at least one SEQ ID NO: 22 and at least one SEQ ID NO: 38 as described in International Patent Publication No. WO2013109713, the contents of which are herein incorporated by reference in its entirety.

Vaccines

As described herein, provided are mRNAs having sequences that are substantially not translatable. Such mRNA is effective as a vaccine when administered to a mammalian subject.

Also provided are modified nucleic acids that contain one or more noncoding regions. Such modified nucleic acids are generally not translated, but are capable of binding to and sequestering one or more translational machinery component such as a ribosomal protein or a transfer RNA (tRNA), thereby effectively reducing protein expression in the cell. The modified nucleic acid may contain a small nucleolar RNA (sno-RNA), micro RNA (miRNA), small interfering RNA (siRNA) or Piwi-interacting RNA (piRNA).

Additionally, certain modified nucleosides, or combinations thereof, when introduced into modified nucleic acids activate the innate immune response. Such activating modified nucleic acids, e.g., modified RNAs, are useful as adjuvants when combined with polypeptide or other vaccines. In certain embodiments, the activated modified mRNAs contain a translatable region which encodes for a polypeptide sequence useful as a vaccine, thus providing the ability to be a self-adjuvant.

Therapeutic Agents

The modified nucleic acids (modified RNAs) and the proteins translated from the modified nucleic acids described herein can be used as therapeutic agents. For example, a modified nucleic acid described herein can be administered to a subject, wherein the modified nucleic acid is translated in vivo to produce a therapeutic peptide in the subject. Provided are compositions, methods, kits, and reagents for treatment or prevention of disease or conditions in humans and other mammals. The active therapeutic agents of the invention include modified nucleic acids, cells containing modified nucleic acids or polypeptides translated from the modified nucleic acids, polypeptides translated from modified nucleic acids, and cells contacted with cells containing modified nucleic acids or polypeptides translated from the modified nucleic acids.

In certain embodiments, provided are combination therapeutics containing one or more modified nucleic acids containing translatable regions that encode for a protein or proteins that boost a mammalian subject's immunity along with a protein that induces antibody-dependent cellular toxicity. For example, provided are therapeutics containing one or more nucleic acids that encode trastuzumab and granulocyte-colony stimulating factor (G-CSF). In particular, such combination therapeutics are useful in Her2+ breast cancer patients who develop induced resistance to trastuzumab. (See, e.g., Albrecht, Immunotherapy. 2(6):795-8 (2010)).

Provided are methods of inducing translation of a recombinant polypeptide in a cell population using the modified nucleic acids described herein. Such translation can be in vivo, ex vivo, in culture, or in vitro. The cell population is contacted with an effective amount of a composition containing a nucleic acid that has at least one nucleoside modification, and a translatable region encoding the recombinant polypeptide. The population is contacted under conditions such that the nucleic acid is localized into one or more cells of the cell population and the recombinant polypeptide is translated in the cell from the nucleic acid.

An effective amount of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the invention are directed to methods of inducing in vivo translation of a recombinant polypeptide in a mammalian subject in need thereof. Therein, an effective amount of a composition containing a nucleic acid that has at least one nucleoside modification and a translatable region encoding the recombinant polypeptide is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

Other aspects of the invention relate to transplantation of cells containing modified nucleic acids to a mammalian subject. Administration of cells to mammalian subjects is known to those of ordinary skill in the art, such as local implantation (e.g., topical or subcutaneous administration), organ delivery or systemic injection (e.g., intravenous injection or inhalation), as is the formulation of cells in pharmaceutically acceptable carrier. Compositions containing modified nucleic acids are formulated for administration intramuscularly, transarterially, intraocularly, vaginally, rectally, intraperitoneally, intravenously, intranasally, subcutaneously, endoscopically, transdermally, or intrathecally. In some embodiments, the composition is formulated for extended release.

The subject to whom the therapeutic agent is administered suffers from or is at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

In certain embodiments, the administered modified nucleic acid directs production of one or more recombinant polypeptides that provide a functional activity which is substantially absent in the cell in which the recombinant polypeptide is translated. For example, the missing functional activity may be enzymatic, structural, or gene regulatory in nature. In related embodiments, the administered modified nucleic acid directs production of one or more recombinant polypeptides that increases (e.g., synergistically) a functional activity which is present but substantially deficient in the cell in which the recombinant polypeptide is translated.

In other embodiments, the administered modified nucleic acid directs production of one or more recombinant polypeptides that replace a polypeptide (or multiple polypeptides) that is substantially absent in the cell in which the recombinant polypeptide is translated. Such absence may be due to genetic mutation of the encoding gene or regulatory pathway thereof. In some embodiments, the recombinant polypeptide increases the level of an endogenous protein in the cell to a desirable level; such an increase may bring the level of the endogenous protein from a subnormal level to a normal level, or from a normal level to a super-normal level.

Alternatively, the recombinant polypeptide functions to antagonize the activity of an endogenous protein present in, on the surface of, or secreted from the cell. Usually, the activity of the endogenous protein is deleterious to the subject, for example, do to mutation of the endogenous protein resulting in altered activity or localization. Additionally, the recombinant polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity. The recombinant proteins described herein are engineered for localization within the cell, potentially within a specific compartment such as the nucleus, or are engineered for secretion from the cell or translocation to the plasma membrane of the cell.

Therapeutics

Provided are methods for treating or preventing a symptom of diseases characterized by missing or aberrant protein activity, by replacing the missing protein activity or overcoming the aberrant protein activity. Because of the rapid initiation of protein production following introduction of modified mRNAs, as compared to viral DNA vectors, the compounds of the present invention are particularly advantageous in treating acute diseases such as sepsis, stroke, and myocardial infarction. Moreover, the lack of transcriptional regulation of the modified mRNAs of the invention is advantageous in that accurate titration of protein production is achievable.

In some embodiments, modified mRNAs and their encoded polypeptides in accordance with the present invention may be used for therapeutic purposes. In some embodiments, modified mRNAs and their encoded polypeptides in accordance with the present invention may be used for treatment of any of a variety of diseases, disorders, and/or conditions, including but not limited to one or more of the following: autoimmune disorders (e.g. diabetes, lupus, multiple sclerosis, psoriasis, rheumatoid arthritis); inflammatory disorders (e.g. arthritis, pelvic inflammatory disease); infectious diseases (e.g. viral infections (e.g., HIV, HCV, RSV), bacterial infections, fungal infections, sepsis); neurological disorders (e.g. Alzheimer's disease, Huntington's disease; autism; Duchenne muscular dystrophy); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); digestive disorders (e.g. inflammatory bowel disease, ulcers); musculoskeletal disorders (e.g. fibromyalgia, arthritis); endocrine, metabolic, and nutritional disorders (e.g. diabetes, osteoporosis); urological disorders (e.g. renal disease); psychological disorders (e.g. depression, schizophrenia); skin disorders (e.g. wounds, eczema); blood and lymphatic disorders (e.g. anemia, hemophilia); etc.

Diseases characterized by dysfunctional or aberrant protein activity include cystic fibrosis, sickle cell anemia, epidermolysis bullosa, amyotrophic lateral sclerosis, and glucose-6-phosphate dehydrogenase deficiency. The present invention provides a method for treating such conditions or diseases in a subject by introducing nucleic acid or cell-based therapeutics containing the modified nucleic acids provided herein, wherein the modified nucleic acids encode for a protein that antagonizes or otherwise overcomes the aberrant protein activity present in the cell of the subject. Specific examples of a dysfunctional protein are the missense mutation variants of the cystic fibrosis transmembrane conductance regulator (CFTR) gene, which produce a dysfunctional protein variant of CFTR protein, which causes cystic fibrosis.

Diseases characterized by missing (or substantially diminished such that proper protein function does not occur) protein activity include cystic fibrosis, Niemann-Pick type C, β thalassemia major, Duchenne muscular dystrophy, Hurler Syndrome, Hunter Syndrome, and Hemophilia A. Such proteins may not be present, or are essentially non-functional. The present invention provides a method for treating such conditions or diseases in a subject by introducing nucleic acid or cell-based therapeutics containing the modified nucleic acids provided herein, wherein the modified nucleic acids encode for a protein that replaces the protein activity missing from the target cells of the subject. Specific examples of a dysfunctional protein are the nonsense mutation variants of the cystic fibrosis transmembrane conductance regulator (CFTR) gene, which produce a non-functional protein variant of CFTR protein, which causes cystic fibrosis.

Thus, provided are methods of treating cystic fibrosis in a mammalian subject by contacting a cell of the subject with a modified nucleic acid having a translatable region that encodes a functional CFTR polypeptide, under conditions such that an effective amount of the CTFR polypeptide is present in the cell. Preferred target cells are epithelial, endothelial and mesothelial cells, such as the lung, and methods of administration are determined in view of the target tissue; i.e., for lung delivery, the RNA molecules are formulated for administration by inhalation.

In another embodiment, the present invention provides a method for treating hyperlipidemia in a subject, by introducing into a cell population of the subject with a modified mRNA molecule encoding Sortilin, a protein recently characterized by genomic studies, thereby ameliorating the hyperlipidemia in a subject. The SORT1 gene encodes a trans-Golgi network (TGN) transmembrane protein called Sortilin. Genetic studies have shown that one of five individuals has a single nucleotide polymorphism, rs12740374, in the 1p13 locus of the SORT1 gene that predisposes them to having low levels of low-density lipoprotein (LDL) and very-low-density lipoprotein (VLDL). Each copy of the minor allele, present in about 30% of people, alters LDL cholesterol by 8 mg/dL, while two copies of the minor allele, present in about 5% of the population, lowers LDL cholesterol 16 mg/dL. Carriers of the minor allele have also been shown to have a 40% decreased risk of myocardial infarction. Functional in vivo studies in mice describes that overexpression of SORT1 in mouse liver tissue led to significantly lower LDL-cholesterol levels, as much as 80% lower, and that silencing SORT1 increased LDL cholesterol approximately 200% (Musunuru K et al. From noncoding variant to phenotype via SORT1 at the 1p13 cholesterol locus. Nature 2010; 466: 714-721, herein incorporated by reference in its entirety.).

Modulation of Cell Fate

Provided are methods of inducing an alteration in cell fate in a target mammalian cell. The target mammalian cell may be a precursor cell and the alteration may involve driving differentiation into a lineage, or blocking such differentiation. Alternatively, the target mammalian cell may be a differentiated cell, and the cell fate alteration includes driving de-differentiation into a pluripotent precursor cell, or blocking such de-differentiation, such as the dedifferentiation of cancer cells into cancer stem cells. In situations where a change in cell fate is desired, effective amounts of mRNAs encoding a cell fate inductive polypeptide is introduced into a target cell under conditions such that an alteration in cell fate is induced. In some embodiments, the modified mRNAs are useful to reprogram a subpopulation of cells from a first phenotype to a second phenotype. Such a reprogramming may be temporary or permanent.

Optionally, the reprogramming induces a target cell to adopt an intermediate phenotype.

Additionally, the methods of the present invention are particularly useful to generate induced pluripotent stem cells (iPS cells) because of the high efficiency of transfection, the ability to re-transfect cells, and the tenability of the amount of recombinant polypeptides produced in the target cells. Further, the use of iPS cells generated using the methods described herein is expected to have a reduced incidence of teratoma formation.

Also provided are methods of reducing cellular differentiation in a target cell population. For example, a target cell population containing one or more precursor cell types is contacted with a composition having an effective amount of a modified mRNA encoding a polypeptide, under conditions such that the polypeptide is translated and reduces the differentiation of the precursor cell. In non-limiting embodiments, the target cell population contains injured tissue in a mammalian subject or tissue affected by a surgical procedure. The precursor cell is, e.g., a stromal precursor cell, a neural precursor cell, or a mesenchymal precursor cell.

In a specific embodiment, provided are modified nucleic acids that encode one or more differentiation factors Gata4, Mef2c and Tbx4. These mRNA-generated factors are introduced into fibroblasts and drive the reprogramming into cardiomyocytes. Such a reprogramming can be performed in vivo, by contacting an mRNA-containing patch or other material to damaged cardiac tissue to facilitate cardiac regeneration. Such a process promotes cardiomyocyte genesis as opposed to fibrosis.

Targeting of Pathogenic Organisms; Purification of Biological Materials

Provided herein are methods for targeting pathogenic microorganisms, such as bacteria, yeast, protozoa, helminthes and the like, using modified mRNAs that encode cytostatic or cytotoxic polypeptides. Preferably the mRNA introduced into the target pathogenic organism contains modified nucleosides or other nucleic acid sequence modifications that the mRNA is translated exclusively, or preferentially, in the target pathogenic organism, to reduce possible off-target effects of the therapeutic. Such methods are useful for removing pathogenic organisms from biological material, including blood, semen, eggs, and transplant materials including embryos, tissues, and organs.

Targeting Diseased Cells

Provided herein are methods for targeting pathogenic or diseased cells, particularly cancer cells, using modified mRNAs that encode cytostatic or cytotoxic polypeptides. Preferably the mRNA introduced into the target pathogenic cell contains modified nucleosides or other nucleic acid sequence modifications that the mRNA is translated exclusively, or preferentially, in the target pathogenic cell, to reduce possible off-target effects of the therapeutic. Alternatively, the invention provides targeting moieties that are capable of targeting the modified mRNAs to preferentially bind to and enter the target pathogenic cell.

Protein Production

The methods provided herein are useful for enhancing protein product yield in a cell culture process. In a cell culture containing a plurality of host cells, introduction of the modified mRNAs described herein results in increased protein production efficiency relative to a corresponding unmodified nucleic acid. Such increased protein production efficiency can be demonstrated, e.g., by showing increased cell transfection, increased protein translation from the nucleic acid, decreased nucleic acid degradation, and/or reduced innate immune response of the host cell. Protein production can be measured by ELISA, and protein activity can be measured by various functional assays known in the art. The protein production may be generated in a continuous or a fed-batch mammalian process.

Additionally, it is useful to optimize the expression of a specific polypeptide in a cell line or collection of cell lines of potential interest, particularly an engineered protein such as a protein variant of a reference protein having a known activity. In one embodiment, provided is a method of optimizing expression of an engineered protein in a target cell, by providing a plurality of target cell types, and independently contacting with each of the plurality of target cell types a modified mRNA encoding an engineered polypeptide. Additionally, culture conditions may be altered to increase protein production efficiency. Subsequently, the presence and/or level of the engineered polypeptide in the plurality of target cell types is detected and/or quantitated, allowing for the optimization of an engineered polypeptide's expression by selection of an efficient target cell and cell culture conditions relating thereto. Such methods are particularly useful when the engineered polypeptide contains one or more post-translational modifications or has substantial tertiary structure, situations which often complicate efficient protein production.

Gene Silencing

The modified mRNAs described herein are useful to silence (i.e., prevent or substantially reduce) expression of one or more target genes in a cell population. A modified mRNA encoding a polypeptide capable of directing sequence-specific histone H3 methylation is introduced into the cells in the population under conditions such that the polypeptide is translated and reduces gene transcription of a target gene via histone H3 methylation and subsequent heterochromatin formation. In some embodiments, the silencing mechanism is performed on a cell population present in a mammalian subject. By way of non-limiting example, a useful target gene is a mutated Janus Kinase-2 family member, wherein the mammalian subject expresses the mutant target gene suffers from a myeloproliferative disease resulting from aberrant kinase activity.

Co-administration of modified mRNAs and siRNAs are also provided herein. As demonstrated in yeast, sequence-specific trans silencing is an effective mechanism for altering cell function. Fission yeast require two RNAi complexes for siRNA-mediated heterochromatin assembly: the RNA-induced transcriptional silencing (RITS) complex and the RNA-directed RNA polymerase complex (RDRC) (Motamedi et al. Cell 2004, 119, 789-802). In fission yeast, the RITS complex contains the siRNA binding Argonaute family protein Ago1, a chromodomain protein Chp1, and Tas3. The fission yeast RDRC complex is composed of an RNA-dependent RNA Polymerase Rdp1, a putative RNA helicase Hrr1, and a polyA polymerase family protein Cid12. These two complexes require the Dicer ribonuclease and Clr4 histone H3 methyltransferase for activity. Together, Ago1 binds siRNA molecules generated through Dicer-mediated cleavage of Rdp1 co-transcriptionally generated dsRNA transcripts and allows for the sequence-specific direct association of Chp1, Tas3, Hrr1, and Clr4 to regions of DNA destined for methylation and histone modification and subsequent compaction into transcriptionally silenced heterochromatin. While this mechanism functions in cis- with centromeric regions of DNA, sequence-specific trans silencing is possible through co-transfection with double-stranded siRNAs for specific regions of DNA and concomitant RNAi-directed silencing of the siRNA ribonuclease Eri1 (Buhler et al. Cell 2006, 125, 873-886, herein incorporated by reference in its entirety.).

Modulation of Biological Pathways

The rapid translation of modified mRNAs introduced into cells provides a desirable mechanism of modulating target biological pathways. Such modulation includes antagonism or agonism of a given pathway. In one embodiment, a method is provided for antagonizing a biological pathway in a cell by contacting the cell with an effective amount of a composition comprising a modified nucleic acid encoding a recombinant polypeptide, under conditions such that the nucleic acid is localized into the cell and the recombinant polypeptide is capable of being translated in the cell from the nucleic acid, wherein the recombinant polypeptide inhibits the activity of a polypeptide functional in the biological pathway. Exemplary biological pathways are those defective in an autoimmune or inflammatory disorder such as multiple sclerosis, rheumatoid arthritis, psoriasis, lupus erythematosus, ankylosing spondylitis colitis, or Crohn's disease; in particular, antagonism of the IL-12 and IL-23 signaling pathways are of particular utility. (See Kikly K, Liu L, Na S, Sedgwick J D (2006) Curr. Opin. Immunol. 18 (6): 670-5, herein incorporated by reference in its entirety.).

Further, provided are modified nucleic acids encoding an antagonist for chemokine receptors; chemokine receptors CXCR-4 and CCR-5 are required for, e.g., HIV entry into host cells (Arenzana-Seisdedos F et al, (1996) Nature. October 3; 383(6599):400, herein incorporated by reference in its entirety.).

Alternatively, provided are methods of agonizing a biological pathway in a cell by contacting the cell with an effective amount of a modified nucleic acid encoding a recombinant polypeptide under conditions such that the nucleic acid is localized into the cell and the recombinant polypeptide is capable of being translated in the cell from the nucleic acid, and the recombinant polypeptide induces the activity of a polypeptide functional in the biological pathway. Exemplary agonized biological pathways include pathways that modulate cell fate determination. Such agonization is reversible or, alternatively, irreversible.

Cellular Nucleic Acid Delivery

Methods of the present invention enhance nucleic acid delivery into a cell population, in vivo, ex vivo, or in culture. For example, a cell culture containing a plurality of host cells (e.g., eukaryotic cells such as yeast or mammalian cells) is contacted with a composition that contains an enhanced nucleic acid having at least one nucleoside modification and, optionally, a translatable region. The composition also generally contains a transfection reagent or other compound that increases the efficiency of enhanced nucleic acid uptake into the host cells. The enhanced nucleic acid exhibits enhanced retention in the cell population, relative to a corresponding unmodified nucleic acid. The retention of the enhanced nucleic acid is greater than the retention of the unmodified nucleic acid. In some embodiments, it is at least about 50%, 75%, 90%, 95%, 100%, 150%, 200% or more than 200% greater than the retention of the unmodified nucleic acid. Such retention advantage may be achieved by one round of transfection with the enhanced nucleic acid, or may be obtained following repeated rounds of transfection.

In some embodiments, the enhanced nucleic acid is delivered to a target cell population with one or more additional nucleic acids. Such delivery may be at the same time, or the enhanced nucleic acid is delivered prior to delivery of the one or more additional nucleic acids. The additional one or more nucleic acids may be modified nucleic acids or unmodified nucleic acids. It is understood that the initial presence of the enhanced nucleic acids does not substantially induce an innate immune response of the cell population and, moreover, that the innate immune response will not be activated by the later presence of the unmodified nucleic acids. In this regard, the enhanced nucleic acid may not itself contain a translatable region, if the protein desired to be present in the target cell population is translated from the unmodified nucleic acids.

IV. Pharmaceutical Compositions

Formulation, Administration, Delivery and Dosing

The present invention provides polynucleotides, modified nucleic acid, enhanced modified RNA and ribonucleic acid compositions and complexes in combination with one or more pharmaceutically acceptable excipients. Pharmaceutical compositions may optionally comprise one or more additional active substances, e.g. therapeutically and/or prophylactically active substances. General considerations in the formulation and/or manufacture of pharmaceutical agents may be found, for example, in *Remington: The Science and Practice of Pharmacy* 21$^{st}$ ed., Lippincott Williams & Wilkins, 2005 (incorporated herein by reference).

In one embodiment, provided are formulations containing an effective amount of a ribonucleic acid (e.g., an mRNA or a nucleic acid containing an mRNA) engineered to avoid an innate immune response of a cell into which the ribonucleic acid enters. The ribonucleic acid generally includes a nucleotide sequence encoding a polypeptide of interest.

In some embodiments, compositions are administered to humans, human patients or subjects. For the purposes of the present disclosure, the phrase "active ingredient" generally refers to a modified nucleic acid, an enhanced nucleic aicd or a ribonucleic acid to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient
Formulations The polynucleotides, modified nucleic acid, enhanced modified RNA and ribonucleic acid of the invention can be formulated using one or more excipients to: (1) increase stability; (2) increase cell transfection; (3) permit the sustained or delayed release (e.g., from a depot formulation of the modified nucleic acids, enhanced modified RNA or ribonucleic acids); (4) alter the biodistribution (e.g., target the modified nucleic acids, enhanced modified RNA or ribonucleic acids to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides, modified nucleic acid, enhanced modified RNA and ribonucleic acid (e.g., for transplantation into a subject), hyaluronidase, nanoparticle mimics and combinations thereof.

Accordingly, the formulations of the invention can include one or more excipients, each in an amount that together increases the stability of the polynucleotide, modified nucleic acid, enhanced modified RNA or ribonucleic acid, increases cell transfection by the polynucleotides, modified nucleic acid, enhanced modified RNA or ribonucleic acid, increases the expression of polynucleotides, modified nucleic acid, enhanced modified RNA or ribonucleic acid encoded protein, and/or alters the release profile of the polynucleotides, modified nucleic acid, enhanced modified RNA or ribonucleic acid encoded proteins. Further, the polynucleotides, modified nucleic acid, enhanced modified RNA or ribonucleic acid of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

The polynucleotides, modified nucleic acid, enhanced modified RNA and ribonucleic acid of the invention may be formulated for delivery in the tissues and/or organs of a subject. Organs may include, but are not limited to, the heart, lung, brain, liver, basal ganglia, brain stem medulla, midbrain, pons, cerebellum, cerebral cortex, hypothalamus, eye, pituitary, thyroid, parathyroid, esophagus, thymus, adrenal glands, appendix, bladder, gallbladder, intestines (e.g., large intestine and small intestine), kidney, pancreas, spleen, stomach, skin, prostate, testes, ovaries, uterus, adrenal glands, anus, bronchi, ears, esophagus, genitals, larynx (voice box), lymph nodes, meninges, mouth, nose, parathyroid glands, pituitary gland, rectum, salivary glands, spinal cord, thymus gland, tongue, trachea, ureters, urethra, colon. Tissues may include, but are not limited to, heart valves, bone, vein, middle ear, muscle (cardiac, smooth or skeletal) cartilage, tendon or ligaments. As a non-limiting example, the polynucleotides, modified nucleic acid, enhanced modified RNA and ribonucleic acid may be formulated in a lipid nanoparticle and delivered to an organ such as, but not limited, to the liver, spleen, kidney or lung. In another non-limiting example, the polynucleotides, modified nucleic acids, enhanced modified RNA and ribonucleic acid may be formulated in a lipid nanoparticle comprising the cationic lipid DLin-KC2-DMA and delivered to an organ such as, but not limited to, the liver, spleen, kidney or lung.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient may generally be equal to the dosage of the active ingredient which would be administered to a subject and/or a convenient fraction of such a dosage including, but not limited to, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient.

In some embodiments, the modified mRNA formulations described herein may contain at least one modified mRNA. The formulations may contain 1, 2, 3, 4 or 5 modified mRNA. In one embodiment the formulation may contain modified mRNA encoding proteins selected from categories such as, but not limited to, human proteins, veterinary proteins, bacterial proteins, biological proteins, antibodies, immunogenic proteins, therapeutic peptides and proteins, secreted proteins, plasma membrane proteins, cytoplasmic and cytoskeletal proteins, intracellular membrane bound proteins, nuclear proteins, proteins associated with human disease and/or proteins associated with non-human diseases. In one embodiment, the formulation contains at least three modified mRNA encoding proteins. In one embodiment, the formulation contains at least five modified mRNA encoding proteins.

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention Lipidoid The synthesis of lipidoids has been extensively described and formulations containing these compounds are particularly suited for delivery of polynucleotides, modified nucleic acids, enhanced modified RNA and ribonucleic acids (see Mahon et al., Bioconjug Chem. 2010 21:1448-1454; Schroeder et al., J Intern Med. 2010 267:9-21; Akinc et al., Nat. Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat. Biotechnol. 2008 26:561-569; Frank-Kamenetsky et al., Proc Natl Acad Sci USA. 2008 105:11915-11920; Akinc et al., Mol. Ther. 2009 17:872-879; Love et al., Proc Natl Acad Sci USA. 2010 107:1864-1869; Leuschner et al., Nat. Biotechnol. 2011 29:1005-1010; all of which is incorporated herein in their entirety), the present disclosure describes their formulation and use in delivering single stranded polynucleotide, modified nucleic acids, enhanced modified RNA and ribonucleic acids. Complexes, micelles, liposomes or particles can be prepared containing these lipidoids and therefore, can result in an effective delivery of the polynucleotides, modified nucleic acids, enhanced modified RNA and ribonucleic acids, as judged by the production of an encoded protein, following the injection of a lipidoid formulation via localized and/or systemic routes of administration. Lipidoid complexes of polynucleotides, modified nucleic acids, enhanced modified RNA and ribonucleic acids can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, oligonucleotide to lipid ratio, and biophysical parameters such as particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010)), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-670; both of which are herein incorporated by reference in their entirety. The lipidoid formulations can include particles comprising either 3 or 4 or more components in addition to polynucleotide, modified nucleic acids, enhanced modified RNA and ribonucleic acids. As an example, formulations with certain lipidoids, include, but are not limited to, 98N12-5 and may contain 42% lipidoid, 48% cholesterol and 10% PEG ($C_{1-4}$ alkyl chain length). As another example, formulations with certain lipidoids, include, but are not limited to, C12-200 and may contain 50% lipidoid, 10% disteroylphosphatidyl choline, 38.5% cholesterol, and 1.5% PEG-DMG.

In one embodiment, a modified nucleic acids, enhanced modified RNA or ribonucleic acids formulated with a lipidoid for systemic intravenous administration can target the liver. For example, a final optimized intravenous formulation using modified nucleic acids, enhanced modified RNA or ribonucleic acids, and comprising a lipid molar composition of 42% 98N12-5, 48% cholesterol, and 10% PEG-lipid with a final weight ratio of about 7.5 to 1 total lipid to polynucleotide, modified nucleic acids, enhanced modified RNA or ribonucleic acids, and a $C_{1-4}$ alkyl chain length on the PEG lipid, with a mean particle size of roughly 50-60 nm, can result in the distribution of the formulation to be greater than 90% to the liver. (see, Akinc et al., Mol. Ther. 2009 17:872-879; herein incorporated in its entirety). In another example, an intravenous formulation using a C12-200 (see U.S. provisional application 61/175,770 and published international application WO2010129709, each of which is herein incorporated by reference in their entirety) lipidoid may have a molar ratio of 50/10/38.5/1.5 of C12-200/disteroylphosphatidyl choline/cholesterol/PEG-DMG, with a weight ratio of 7 to 1 total lipid to polynucleotide, modified nucleic acids, enhanced modified RNA or ribonucleic acids, and a mean particle size of 80 nm may be effective to deliver polynucleotides, modified nucleic acids, enhanced modified RNA or ribonucleic acids to hepatocytes (see, Love et al., Proc Natl Acad Sci USA. 2010 107:1864-1869 herein incorporated by reference). In another embodiment, an MD1 lipidoid-containing formulation may be used to effectively deliver polynucleotides, modified nucleic acids, enhanced modified RNA or ribonucleic acids to hepatocytes in vivo. The characteristics of optimized lipidoid formulations for intramuscular or subcutaneous routes may vary significantly depending on the target cell type and the ability of formulations to diffuse through the extracellular matrix into the blood stream. While a particle size of less than 150 nm may be desired for effective hepatocyte delivery due to the size of the endothelial fenestrae (see, Akinc et al., Mol Ther. 2009 17:872-879 herein incorporated by reference), use of a lipidoid-formulated polynucleotides, modified nucleic acids, enhanced modified RNA or ribonucleic acids to deliver the formulation to other cells types including, but not limited to, endothelial cells, myeloid cells, and muscle cells may not be similarly size-limited. Use of lipidoid formulations to deliver siRNA in vivo to other non-hepatocyte cells such as myeloid cells and endothelium has been reported (see Akinc et al., Nat. Biotechnol. 2008 26:561-569; Leuschner et al., Nat. Biotechnol. 2011 29:1005-1010; Cho et al. Adv. Funct. Mater. 2009 19:3112-3118; 8th International Judah Folkman Conference, Cambridge, Mass. Oct. 8-9, 2010 herein incorporated by reference in its entirety). Effective delivery to myeloid cells, such as monocytes, lipidoid formulations may have a similar component molar ratio. Different ratios of lipidoids and other components including, but not limited to, disteroylphosphatidyl choline, cholesterol and PEG-DMG, may be used to optimize the formulation of the polynucleotides, modified nucleic acids, enhanced modified RNA or ribonucleic acids for delivery to different cell types including, but not limited to, hepatocytes, myeloid cells, muscle cells, etc. For example, the component molar ratio may include, but is not limited to, 50% C12-200, 10% disteroylphosphatidyl choline, 38.5% cholesterol, and %1.5 PEG-DMG (see Leuschner et al., Nat Biotechnol 2011 29:1005-1010; herein incorporated by reference in its entirety). The use of lipidoid formulations for the localized delivery of nucleic acids to cells (such as, but not limited to, adipose cells and muscle cells) via either subcutaneous or intramuscular delivery, may not require all of the formulation components desired for systemic delivery, and as such may comprise only the lipidoid and the polynucleotides, modified nucleic acids, enhanced modified RNA or ribonucleic acids.

Combinations of different lipidoids may be used to improve the efficacy of polynucleotides, modified nucleic acids, enhanced modified RNA or ribonucleic acids directed protein production as the lipidoids may be able to increase cell transfection by the polynucleotides, modified nucleic acid, or modified nucleic acids, enhanced modified RNA or ribonucleic acids; and/or increase the translation of encoded protein (see Whitehead et al., Mol. Ther. 2011, 19:1688-1694, herein incorporated by reference in its entirety).

Liposomes, Lipoplexes, and Lipid Nanoparticles

The polynucleotides, modified nucleic acids, enhanced modified RNA or ribonucleic acids of the invention can be formulated using one or more liposomes, lipoplexes, or lipid nanoparticles. In one embodiment, pharmaceutical compositions of polynucleotides, modified nucleic acids, enhanced modified RNA or ribonucleic acids include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.). In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat. Biotechnol. 2005 2:1002-1007; Zimmermann et al., Nature. 2006 441:111-114; Heyes et al. J Contr Rel. 2005 107:276-287; Semple et al. Nature Biotech.

2010 28:172-176; Judge et al. J Clin Invest. 2009 119:661-673; deFougerolles *Hum Gene Ther.* 2008 19:125-132; all of which are incorporated herein in their entireties.) The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotides, modified nucleic acids, enhanced modified RNA or ribonucleic acids. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In one embodiment, pharmaceutical compositions may include liposomes which may be formed to deliver polynucleotides, modified nucleic acids, enhanced modified RNA and ribonucleic acids which may encode at least one immunogen. The polynucleotides, modified nucleic acids, enhanced modified RNA and ribonucleic acids may be encapsulated by the liposome and/or it may be contained in an aqueous core which may then be encapsulated by the liposome (see International Pub. Nos. WO2012031046, WO2012031043, WO2012030901 and WO2012006378; each of which is herein incorporated by reference in their entirety). In another polynucleotides, embodiment, the modified nucleic acids, enhanced modified RNA and ribonucleic acids which may encode an immunogen may be formulated in a cationic oil-in-water emulsion where the emulsion particle comprises an oil core and a cationic lipid which can interact with the polynucleotides, modified nucleic acids, enhanced modified RNA and ribonucleic acids anchoring the molecule to the emulsion particle (see International Pub. No. WO2012006380). In yet another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; each of which is herein incorporated by reference in their entirety). In another embodiment, the polynucleotides, modified nucleic acids, enhanced modified RNA or ribonucleic acids encoding an immunogen may be formulated in a lipid vesicle which may have crosslinks between functionalized lipid bilayers (see U.S. Pub. No. 20120177724, herein incorporated by reference in its entirety).

In one embodiment, the polynucleotides, modified nucleic acids, enhanced modified RNA or ribonucleic acids may be formulated in a lipid vesicle which may have crosslinks between functionalized lipid bilayers.

In one embodiment, the polynucleotides, modified nucleic acids, enhanced modified RNA or ribonucleic acids may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine. In another embodiment, the polynucleotide, modified nucleic acids, enhanced modified RNA or ribonucleic acids may be formulated in a lipid-polycation complex which may further include a neutral lipid such as, but not limited to, cholesterol or dioleoyl phosphatidylethanolamine (DOPE).

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety).

In some embodiments, the ratio of PEG in the LNP formulations may be increased or decreased and/or the carbon chain length of the PEG lipid may be modified from C14 to C18 to alter the pharmacokinetics and/or biodistribution of the LNP formulations. As a non-limiting example, LNP formulations may contain 1-5% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol) or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the cationic lipid may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865 and WO2008103276, U.S. Pat. Nos. 7,893,302 and 7,404,969 and US Patent Publication No. US20100036115; each of which is herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365 and WO2012044638; each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXXII of U.S. Pat. No. 7,404,969 and formula I-VI of US Patent Publication No. US20100036115; each of which is herein incorporated by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N~dimethylpentacosa-16,19-dien-8-amine, (13Z,16Z)—N,N-dimethyldocosa-13J16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimethyloctacosa-19,22-dien-9-amine, (18Z,21Z)—N,N-dimethylheptacosa-18,21-dien-8- amine, (17Z,20Z)—N,N-dimethylhexacosa-17,20-dien-7-amine, (16Z;19Z)—N,N-dimethylpentacosa-16,19-dien-6-amine, (22Z,25Z)—N,N-dimethylhentriaconta-22,25-dien-10-amine, (21Z,24Z)—N;N-dimethyltriaconta-21,24-dien-9-amine, (18Z)—N,N-dimethylheptacos-18-en-10-amine, (17Z)—N,N-dimethylhexacos-17-en-9-amine, (19Z,22Z)—NJN-dimethyloctacosa-19,22-dien-7-amine, N,N-dimethylheptacosan-10-amine, (20Z,23Z)—N-ethyl-N-methylnonacosa-20J23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21~[(1S,2R)-2-octylcyclopropyl]henicosan-10-amine, N,N-dimethyl-1-[(1S,2S)-2-{[(1R,2R)-2-pentylcyclopropyl]methyl}cyclopropyl]nonadecan-10-amine, N,N-dimethyl-1-[(1S,2R)-2-octylcyclopropyl]hexadecan-8-amine, N,N-dimethyH-[(1R,2S)-2-undecylcyclopropyl]tetradecan-5-amine, N,N-dimethyl-3-{7-[(1S,2R)-2-octylcyclopropyl]heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy) methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine (Compound 9); (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N;N-dimethylnonacosa-11,20,2-trien-10-amine or a pharmaceutically acceptable salt or stereoisomer thereof.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724 and WO201021865; each of which is herein incorporated by reference in their entirety.

In one embodiment, the LNP formulation may contain PEG-c-DOMG 3% lipid molar ratio. In another embodiment, the LNP formulation may contain PEG-c-DOMG 1.5% lipid molar ratio.

In one embodiment, the LNP formulation may contain PEG-DMG 2000 (1,2-dimyristoyl-sn-glycero-3-phophoethanolamine-N-[methoxy(polyethylene glycol)-2000). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see Geall et al., Nonviral delivery of self-amplifying RNA vaccines, PNAS 2012; PMID: 22908294).

In one embodiment, the LNP formulation may be formulated by the methods described in International Publication Nos. WO2011127255 or WO2008103276, each of which is herein incorporated by reference in their entirety. As a non-limiting example, modified RNA described herein may be encapsulated in LNP formulations as described in WO2011127255 and/or WO2008103276; each of which is herein incorporated by reference in their entirety.

In one embodiment, LNP formulations described herein may comprise a polycationic composition. As a non-limiting example, the polycationic composition may be selected from formula 1-60 of US Patent Publication No. US20050222064; herein incorporated by reference in its entirety. In another embodiment, the LNP formulations comprising a polycationic composition may be used for the delivery of the modified RNA described herein in vivo and/or in vitro.

In one embodiment, the LNP formulations described herein may additionally comprise a permeability enhancer molecule. Non-limiting permeability enhancer molecules are described in US Patent Publication No. US20050222064; herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713)) and hyaluronan-coated liposomes (Quiet Therapeutics, Israel).

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon. Non-limiting examples of reLNPs include, delivery of a wide array of drugs have been thought to be too large to rapidly diffuse through mucosal barriers. Mucus is continuously secreted, shed, discarded or digested and recycled so most of the trapped particles may be removed from the mucosla tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; each of which is herein incorporated by reference in their entirety). The transport of nanoparticles may be determined using rates of permeation and/or fluorescent microscopy tech-

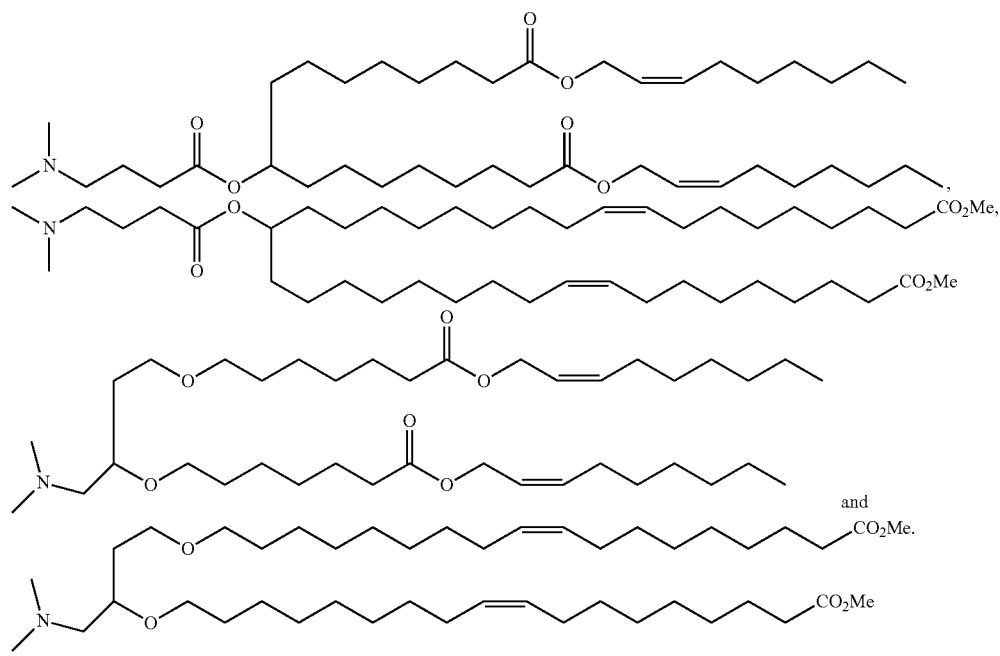

In one embodiment, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained niques including, but not limited to, fluorescence recovery after photobleaching (FRAP) and high resolution multiple particle tracking (MPT).

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L- lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth)acrylate), poly(butyl(meth)acrylate), poly(isobutyl(meth)acrylate), poly(hexyl(meth)acrylate), poly(isodecyl(meth)acrylate), poly(lauryl(meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), and trimethylene carbonate, polyvinylpyrrolidone. The lipid nanoparticle may be coated or associated with a co-polymer such as, but not limited to, a block co-polymer, and (poly(ethylene glycol))-(poly(propylene oxide))-(poly(ethylene glycol)) triblock copolymer (see US Publication 20120121718 and US Publication 20100003337; each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; herein incorporated by reference in its entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, polynucleotides, modified nucleic acids, enhanced modified RNA, ribonucleic acids, anionic protein (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see US Publication 20100215580 and US Publication 20080166414; each of which is herein incorporated by reference in their entirety).

The mucus penetrating lipid nanoparticles may comprise at least one polynucleotide, modified nucleic acids, enhanced modified RNA or ribonucleic acids described herein. The modified nucleic acids, enhanced modified RNA or ribonucleic acids may be encapsulated in the lipid nanoparticle and/or disposed on the surface of the particle. The polynucleotide, modified nucleic acids, enhanced modified RNA or ribonucleic acids may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion which may increase the delivery of the mucus penetrating lipid nanoparticles to the mucosal tissue.

In one embodiment, the polynucleotide, modified nucleic acids, enhanced modified RNA or ribonucleic acids is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles *Hum Gene Ther.* 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and MC3-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, *Front Biosci.* 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714 Zhao et al., Expert Opin Drug Deliv. 2008

5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the polynucleotide, modified nucleic acids, enhanced modified RNA or ribonucleic acids is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; herein incorporated by reference in its entirety).

Liposomes, lipoplexes, or lipid nanoparticles may be used to improve the efficacy of polynucleotides, modified nucleic acids, enhanced modified RNA or ribonucleic acids directed protein production as these formulations may be able to increase cell transfection by the polynucleotides, modified nucleic acids, enhanced modified RNA or ribonucleic acids; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the polynucleotides, modified nucleic acids, enhanced modified RNA or ribonucleic acids.

In one embodiment, the polynucleotide, modified nucleic acids, enhanced modified RNA or ribonucleic acids of the present invention can be formulated for controlled release and/or targeted delivery. As used herein, "controlled release" refers to a pharmaceutical composition or compound release profile that conforms to a particular pattern of release to effect a therapeutic outcome. In one embodiment, the polynucleotide, modified nucleic acids, enhanced modified RNA or ribonucleic acids may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention may be enclosed, surrounded or encased within the delivery agent. "Partially encapsulation" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In another embodiment, the polynucleotides, modified nucleic acids, enhanced modified RNA or ribonucleic acids may be encapsulated into a lipid nanoparticle or a rapidly eliminating lipid nanoparticle and the lipid nanoparticles or a rapidly eliminating lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In one embodiment, the lipid nanoparticle may be encapsulated into any polymer or hydrogel known in the art which may form a gel when injected into a subject. As another non-limiting example, the lipid nanoparticle may be encapsulated into a polymer matrix which may be biodegradable.

In one embodiment, the polynucleotides, modified nucleic acids, enhanced modified RNA or ribonucleic acids formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RED, EUDRAGIT RS® and cellulose derivatives such as ethylcellulose aqueous dispersions (AQUACOAT® and SURELEASE®).

In one embodiment, the controlled release and/or targeted delivery formulation may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In one embodiment, the modified nucleic acids, enhanced modified RNA or ribonucleic acids of the present invention may be encapsulated in a therapeutic nanoparticle. Therapeutic nanoparticles may be formulated by methods described herein and known in the art such as, but not limited to, International Pub Nos. WO2010005740, WO2010030763, WO2010005721, WO2010005723, WO2012054923, US Pub. Nos. US20110262491, US20100104645, US20100087337, US20100068285, US20110274759, US20100068286, and U.S. Pat. No. 8,206, 747; each of which is herein incorporated by reference in their entirety. In another embodiment, therapeutic polymer nanoparticles may be identified by the methods described in US Pub No. US20120140790, herein incorporated by reference in its entirety.

In one embodiment, the therapeutic nanoparticle may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides, modified nucleic acids, enhanced modified RNA or ribonucleic acids of the present invention (see International Pub No. 2010075072 and US Pub No. US20100216804 and US20110217377, each of which is herein incorporated by reference in their entirety).

In one embodiment, the therapeutic nanoparticles may be formulated to be target specific. As a non-limiting example, the therapeutic nanoparticles may include a corticosteroid (see International Pub. No. WO2011084518). In one embodiment, the therapeutic nanoparticles may be formulated to be cancer specific. As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, each of which is herein incorporated by reference in their entirety.

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. As a non-limiting example the therapeutic nanoparticle comprises a PLGA-PEG block copolymer (see US Pub. No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968, herein incorporated by reference in its entirety).

In one embodiment, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the therapeutic nanoparticles may comprise at least one cationic polymer described herein and/or known in the art.

In one embodiment, the therapeutic nanoparticles may comprise at least one amine-containing polymer such as, but not limited to polylysine, polyethylene imine, poly(amidoamine) dendrimers and combinations thereof.

In one embodiment, the therapeutic nanoparticles may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In another embodiment, the therapeutic nanoparticle may include a conjugation of at least one targeting ligand.

In one embodiment, the therapeutic nanoparticle may be formulated in an aqueous solution which may be used to target cancer (see International Pub No. WO2011084513 and US Pub No. US20110294717, each of which is herein incorporated by reference in their entirety).

In one embodiment, the polynucleotides, modified nucleic acids, enhanced modified RNA or ribonucleic acids may be encapsulated in, linked to and/or associated with synthetic nanocarriers. The synthetic nanocarriers may be formulated using methods known in the art and/or described herein. As a non-limiting example, the synthetic nanocarriers may be formulated by the methods described in International Pub Nos. WO2010005740, WO2010030763 and US Pub. Nos. US20110262491, US20100104645 and US20100087337, each of which is herein incorporated by reference in their entirety. In another embodiment, the synthetic nanocarrier formulations may be lyophilized by methods described in International Pub. No. WO2011072218 and U.S. Pat. No. 8,211,473; each of which is herein incorporated by reference in their entirety.

In one embodiment, the synthetic nanocarriers may contain reactive groups to release the modified nucleic acids, enhanced modified RNA or ribonucleic acids described herein (see International Pub. No. WO20120952552 and US Pub No. US20120171229, each of which is herein incorporated by reference in their entirety).

In one embodiment, the synthetic nanocarriers may contain an immunostimulatory agent to enhance the immune response from delivery of the synthetic nanocarrier. As a non-limiting example, the synthetic nanocarrier may comprise a Th1 immunostimulatory agent which may enhance a Th1-based response of the immune system (see International Pub No. WO2010123569 and US Pub. No. US20110223201, each of which is herein incorporated by reference in its entirety).

In one embodiment, the synthetic nanocarriers may be formulated for targeted release. In one embodiment, the synthetic nanocarrier is formulated to release the polynucleotides, modified nucleic acids, enhanced modified RNA or ribonucleic acids at a specified pH and/or after a desired time interval. As a non-limiting example, the synthetic nanoparticle may be formulated to release the modified nucleic acids, enhanced modified RNA or ribonucleic acids after 24 hours and/or at a pH of 4.5 (see International Pub. Nos. WO2010138193 and WO2010138194 and US Pub Nos. US20110020388 and US20110027217, each of which is herein incorporated by reference in their entirety).

In one embodiment, the synthetic nanocarriers may be formulated for controlled and/or sustained release of the polynucleotides, modified nucleic acids, enhanced modified RNA or ribonucleic acids described herein. As a non-limiting example, the synthetic nanocarriers for sustained release may be formulated by methods known in the art, described herein and/or as described in International Pub No. WO2010138192 and US Pub No. 20100303850, each of which is herein incorporated by reference in their entirety.

In one embodiment, the synthetic nanocarrier may be formulated for use as a vaccine. In one embodiment, the synthetic nanocarrier may encapsulate at least one modified nucleic acids, enhanced modified RNA or ribonucleic acids which encodes at least one antigen. As a non-limiting example, the synthetic nanocarrier may include at least one antigen and an excipient for a vaccine dosage form (see International Pub No. WO2011150264 and US Pub No. US20110293723, each of which is herein incorporated by reference in their entirety). As another non-limiting example, a vaccine dosage form may include at least two synthetic nanocarriers with the same or different antigens and an excipient (see International Pub No. WO2011150249 and US Pub No. US20110293701, each of which is herein incorporated by reference in their entirety). The vaccine dosage form may be selected by methods described herein, known in the art and/or described in International Pub No. WO2011150258 and US Pub No. US20120027806, each of which is herein incorporated by reference in their entirety).

In one embodiment, the synthetic nanocarrier may comprise at least one polynucleotide, modified nucleic acids, enhanced modified RNA or ribonucleic acids which encodes at least one adjuvant. In another embodiment, the synthetic nanocarrier may comprise at least one modified nucleic acids, enhanced modified RNA or ribonucleic acids and an adjuvant. As a non-limiting example, the synthetic nanocarrier comprising and adjuvant may be formulated by the methods described in International Pub No. WO2011150240 and US Pub No. US20110293700, each of which is herein incorporated by reference in its entirety.

In one embodiment, the synthetic nanocarrier may encapsulate at least one polynucleotide, modified nucleic acids, enhanced modified RNA or ribonucleic acids which encodes a peptide, fragment or region from a virus. As a non-limiting example, the synthetic nanocarrier may include, but is not limited to, the nanocarriers described in International Pub No. WO2012024621, WO201202629, WO2012024632 and US Pub No. US20120064110, US20120058153 and US20120058154, each of which is herein incorporated by reference in their entirety.

Polymers, Biodegradable Nanoparticles, and Core-Shell Nanoparticles

The polynucleotides, modified nucleic acids, enhanced modified RNA or ribonucleic acids of the invention can be formulated using natural and/or synthetic polymers. Non-limiting examples of polymers which may be used for delivery include, but are not limited to, Dynamic POLY-CONJUGATE™ formulations from MIRUS® Bio (Madison, Wis.) and Roche Madison (Madison, Wis.), PHASERX™ polymer formulations such as, without limitation, SMARTT POLYMER TECHNOLOGY™ (Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers, RONDEL™ (RNAi/Oligonucleotide Nanoparticle Delivery) polymers (Arrowhead Research Corporation, Pasadena, Calif.) and pH responsive co-block polymers such as, but not limited to, PHASERX™ (Seattle, Wash.).

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles *Hum Gene Ther.* 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles. The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI™ gene product in transferrin receptor-expressing Ewing's sarcoma tumor cells (Hu-Lieskovan et al., Cancer Res. 2005 65: 8984-8982) and siRNA formulated in these nanoparticles was well tolerated in non-human primates (Heidel et al., Proc Natl Acad Sci USA 2007 104: 5715-21). Both of these delivery strategies incorporate rational approaches using both targeted delivery and endosomal escape mechanisms.

The polymer formulation can permit the sustained or delayed release of polynucleotides, modified nucleic acids, enhanced modified RNA or ribonucleic acids (e.g., following intramuscular or subcutaneous injection). The altered release profile for the polynucleotides, modified nucleic acids, enhanced modified RNA or ribonucleic acids can result in, for example, translation of an encoded protein over an extended period of time. The polymer formulation may also be used to increase the stability of the polynucleotide, modified nucleic acids, enhanced modified RNA or ribonucleic acids. Biodegradable polymers have been previously used to protect nucleic acids other than modified nucleic acids, enhanced modified RNA or ribonucleic acids from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

As a non-limiting example modified mRNA may be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradeable, biocompatible polymers which are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; each of which is herein incorporated by reference in its entirety).

The polynucleotides, modified nucleic acids, enhanced modified RNA or ribonucleic acids of the invention may be formulated with or in a polymeric compound. The polymer may include at least one polymer such as, but not limited to, polyethenes, polyethylene glycol (PEG), poly(1-lysine) (PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, biodegradable block copolymer, biodegradable random copolymer, biodegradable polyester copolymer, biodegradable polyester block copolymer, biodegradable polyester block random copolymer, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester), acrylic polymers, amine-containing polymers or combinations thereof.

As a non-limiting example, the polynucleotides, modified nucleic acids, enhanced modified RNA or ribonucleic acids of the invention may be formulated with the polymeric compound of PEG grafted with PLL as described in U.S. Pat. No. 6,177,274 herein incorporated by reference in its entirety. The formulation may be used for transfecting cells in vitro or for in vivo delivery of the modified nucleic acids, enhanced modified RNA or ribonucleic acids. In another example, the polynucleotides, modified nucleic acids, enhanced modified RNA or ribonucleic acids may be suspended in a solution or medium with a cationic polymer, in a dry pharmaceutical composition or in a solution that is capable of being dried as described in U.S. Pub. Nos. 20090042829 and 20090042825 each of which are herein incorporated by reference in their entireties.

As another non-limiting example the polynucleotides, modified nucleic acids, enhanced modified RNA or ribonucleic acids of the invention may be formulated with a PLGA-PEG block copolymer (see US Pub. No. US20120004293 and U.S. Pat. No. 8,236,330, each of which are herein incorporated by reference in their entireties). As a non-limiting example, the polynucleotides, modified nucleic acids, enhanced modified RNA or ribonucleic acids of the invention may be formulated with a diblock copolymer of PEG and PLA or PEG and PLGA (see U.S. Pat. No. 8,246,968, herein incorporated by reference in its entirety).

A polyamine derivative may be used to deliver nucleic acids or to treat and/or prevent a disease or to be included in an implantable or injectable device (U.S. Pub. No. 20100260817 herein incorporated by reference in its entirety). As a non-limiting example, a pharmaceutical composition may include the modified nucleic acids, enhanced modified RNA or ribonucleic acids and the polyamine derivative described in U.S. Pub. No. 20100260817 (the contents of which are incorporated herein by reference in its entirety).

The polynucleotides, modified nucleic acids, enhanced modified RNA or ribonucleic acids of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the polynucleotides, modified nucleic acids, enhanced modified RNA or ribonucleic acids of the present invention may be formulated with at least one polymer described in International Publication Nos. WO2011115862, WO2012082574 and WO2012068187, each of which are herein incorporated by reference in their entireties. In another embodiment, the polynucleotides, modified nucleic acids, enhanced modified RNA or ribonucleic acids of the present invention may be formulated with a polymer of formula Z as described in WO2011115862, herein incorporated by reference in its entirety. In yet another embodiment, the polynucleotides, modified nucleic acids, enhanced modified RNA or ribonucleic acids may be formulated with a polymer of formula Z, Z' or Z" as described in WO2012082574 or WO2012068187, each of which are herein incorporated by reference in their entireties. The polymers formulated with the modified RNA of the present invention may be synthesized by the methods described in WO2012082574 or WO2012068187, each of which are herein incorporated by reference in their entireties.

Formulations of polynucleotides, modified nucleic acids, enhanced modified RNA or ribonucleic acids of the invention may include at least one amine-containing polymer such as, but not limited to polylysine, polyethylene imine, poly(amidoamine) dendrimers or combinations thereof.

For example, the polynucleotides, modified nucleic acids, enhanced modified RNA or ribonucleic acids of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made by methods known in the art and/or described in U.S. Pat. No. 6,696,038, U.S. App. Nos. 20030073619 and 20040142474 each of which is herein incorporated by reference in their entireties. The poly(alkylene imine) may be made using methods known in the art and/or as described in U.S. Pub. No. 20100004315, herein incorporated by reference in its entirety. The biodegradabale polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in its entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyargine, polyornithine, histones, avidin, protamines, polylactides and poly(lactide-co-glycolides). The biodegradable cross-linked cationic multi-block copolymers may be made my methods known in the art and/or as described in U.S. Pat. No. 8,057,821 or U.S. Pub. No. 2012009145 each of which are herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos. 6,267,987 and 6,217,912 each of which are herein incorporated by reference in their entireties.

The polynucleotides, modified nucleic acids, enhanced modified RNA or ribonucleic acids of the invention may be formulated with at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In one embodiment, the polymers described herein may be conjugated to a lipid-terminating PEG. As a non-limiting example, PLGA may be conjugated to a lipid-terminating PEG forming PLGA-DSPE-PEG. As another non-limiting example, PEG conjugates for use with the present invention are described in International Publication No. WO2008103276, herein incorporated by reference in its entirety.

In one embodiment, the polynucleotides, modified RNA described herein may be conjugated with another compound. Non-limiting examples of conjugates are described in U.S. Pat. Nos. 7,964,578 and 7,833,992, each of which are herein incorporated by reference in their entireties. In another embodiment, modified RNA of the present invention may be conjugated with conjugates of formula I-122 as described in U.S. Pat. Nos. 7,964,578 and 7,833,992, each of which are herein incorporated by reference in their entireties.

As described in U.S. Pub. No. 20100004313, herein incorporated by reference in its entirety, a gene delivery composition may include a nucleotide sequence and a poloxamer. For example, the polynucleotide, modified nucleic acids, enhanced modified RNA or ribonucleic acids of the present invention may be used in a gene delivery composition with the poloxamer described in U.S. Pub. No. 20100004313.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B—[N—(N',N'-Dimethylaminoethane)-carbamoyl]Cholesterol Hydrochloride (DC-Cholesterol HCl) diheptadecylamidoglycyl spermidine (DOGS), N,N-distearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof.

The polynucleotides, modified nucleic acids, enhanced modified RNA or ribonucleic acids of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to deliver the modified nucleic acids, enhanced modified RNA or ribonucleic acids may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety).

Biodegradable calcium phosphate nanoparticles in combination with lipids and/or polymers have been shown to deliver polynucleotides, modified nucleic acids, enhanced modified RNA or ribonucleic acids in vivo. In one embodiment, a lipid coated calcium phosphate nanoparticle, which may also contain a targeting ligand such as anisamide, may be used to deliver the polynucleotides, modified nucleic acids, enhanced modified RNA or ribonucleic acids of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol. Ther. 2012 20:609-615). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to deliver polynucleotides, modified nucleic acids, enhanced modified RNA or ribonucleic acids (Kazikawa et al., J Contr Rel. 2004 97:345-356; Kazikawa et al., J Contr Rel. 2006 111:368-370).

In one embodiment, a PEG-charge-conversional polymer (Pitella et al., Biomaterials. 2011 32:3106-3114) may be used to form a nanoparticle to deliver the polynucleotides, modified nucleic acids, enhanced modified RNA or ribonucleic acids of the present invention. The PEG-charge-conversional polymer may improve upon the PEG-polyanion block copolymers by being cleaved into a polycation at acidic pH, thus enhancing endosomal escape.

The use of core-shell nanoparticles has additionally focused on a high-throughput approach to synthesize cat-ionic cross-linked nanogel cores and various shells (Siegwart et al., Proc Natl Acad Sci USA. 2011 108:12996-13001). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containing PEG may be used to delivery of the polynucleotide, modified nucleic acids, enhanced modified RNA or ribonucleic acids of the present invention. As a non-limiting example, in mice bearing a luciferease-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031).

Peptides and Proteins

The polynucleotides, modified nucleic acids, enhanced modified RNA or ribonucleic acids of the invention can be formulated with peptides and/or proteins in order to increase transfection of cells by the modified nucleic acids, enhanced modified RNA or ribonucleic acids. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3):310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life Sci. 62(16):1839-49 (2005), all of which are incorporated herein by reference). The compositions can also be formulated to include a cell penetrating agent, e.g., liposomes, which enhance delivery of the compositions to the intracellular space. Modified nucleic acids, enhanced modified RNA or ribonucleic acids of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106:6111-6116; Sawyer, Chem Biol Drug Des. 2009 73:3-6; Verdine and Hilinski, Methods Enzymol. 2012; 503:3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the modified nucleic acids, enhanced modified RNA or ribonucleic acids may be introduced.

Formulations of the including peptides or proteins may be used to increase cell transfection by the polynucleotides, modified nucleic acids, enhanced modified RNA or ribonucleic acids, alter the biodistribution of the polynucleotides, modified nucleic acids, enhanced modified RNA or ribonucleic acids (e.g., by targeting specific tissues or cell types), and/or increase the translation of encoded protein.

Cells

The polynucleotides, modified nucleic acids, enhanced modified RNA or ribonucleic acids of the invention can be transfected ex vivo into cells, which are subsequently transplanted into a subject. As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAX-CYTE® (Gaithersburg, Md.) and from ERYTECH® (Lyon, France) to deliver modified RNA. Examples of use of red blood cells, viral particles and electroporated cells to deliver payloads other than polynucleotides, modified nucleic acids, enhanced modified RNA or ribonucleic acids have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety). The modified RNA may be delivered in synthetic VLPs synthesized by the methods described in International Pub No. WO2011085231 and US Pub No. 20110171248, each of which are herein incorporated by reference in their entireties.

Cell-based formulations of the polynucleotides, modified nucleic acids, enhanced modified RNA or ribonucleic acids of the invention may be used to ensure cell transfection (e.g., in the cellular carrier), alter the biodistribution of the modified nucleic acids, enhanced modified RNA or ribonucleic acids (e.g., by targeting the cell carrier to specific tissues or cell types), and/or increase the translation of encoded protein.

Introduction into Cells

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporaiton, or cellular sonication, is the use of sound (e.g., ultrasonic frequencies) for modifying the permeability of the cell plasma membrane. Sonoporation methods are known to those in the art and are taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art. In one embodiment, modified nucleic acids, enhanced modified RNA or ribonucleic acids may be delivered by electroporation as described in Example 11.

Hyaluronidase

The intramuscular or subcutaneous localized injection of polynucleotides, modified nucleic acids, enhanced modified RNA or ribonucleic acids of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a modified nucleic acids, enhanced modified RNA or ribonucleic acids of the invention administered intramuscularly or subcutaneously.

Nanoparticle Mimics

The polynucleotides, modified nucleic acids, enhanced modified RNA or ribonucleic acids of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the polynucleotides, modified nucleic acids, enhanced modified RNA or ribonucleic acids of the invention may be encapsulated in a non-viron particle which can mimic the delivery function of a virus (see International Pub. No. WO2012006376 herein incorporated by reference in its entirety).

Nanotubes

The polynucleotides, modified nucleic acids, enhanced modified RNA or ribonucleic acids of the invention can be attached or otherwise bound to at least one nanotube such as, but not limited to, rosette nanotubes, rosette nanotubes having twin bases with a linker, carbon nanotubes and/or single-walled carbon nanotubes, The polynucleotides, modified nucleic acids, enhanced modified RNA or ribonucleic acids may be bound to the nanotubes through forces such as, but not limited to, steric, ionic, covalent and/or other forces.

In one embodiment, the nanotube can release one or more polynucleotides, modified nucleic acids, enhanced modified RNA or ribonucleic acids into cells. The size and/or the surface structure of at least one nanotube may be altered so as to govern the interaction of the nanotubes within the body and/or to attach or bind to the polynucleotides, modified nucleic acids, enhanced modified RNA or ribonucleic acids disclosed herein. In one embodiment, the building block and/or the functional groups attached to the building block of the at least one nanotube may be altered to adjust the dimensions and/or properties of the nanotube. As a non-limiting example, the length of the nanotubes may be altered to hinder the nanotubes from passing through the holes in the walls of normal blood vessels but still small enough to pass through the larger holes in the blood vessels of tumor tissue.

In one embodiment, at least one nanotube may also be coated with delivery enhancing compounds including polymers, such as, but not limited to, polyethylene glycol. In another embodiment, at least one nanotube and/or the modified mRNA may be mixed with pharmaceutically acceptable excipients and/or delivery vehicles.

In one embodiment, the polynucleotides or modified mRNA are attached and/or otherwise bound to at least one rosette nanotube. The rosette nanotubes may be formed by a process known in the art and/or by the process described in International Publication No. WO2012094304, herein incorporated by reference in its entirety. At least one modified mRNA may be attached and/or otherwise bound to at least one rosette nanotube by a process as described in International Publication No. WO2012094304, herein incorporated by reference in its entirety, where rosette nanotubes or modules forming rosette nanotubes are mixed in aqueous media with at least one modified mRNA under conditions which may cause at least one modified mRNA to attach or otherwise bind to the rosette nanotubes.

Conjugates

The polynucleotides, modified nucleic acids, enhanced modified RNA or ribonucleic acids of the invention include conjugates, such as a modified nucleic acids, enhanced modified RNA or ribonucleic acids covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931;

6,900,297; 7,037,646; each of which is herein incorporated by reference in their entireties.

In one embodiment, the conjugate of the present invention may function as a carrier for the polynucleotide, modified nucleic acids, enhanced modified RNA or ribonucleic acids of the present invention. The conjugate may comprise a cationic polymer such as, but not limited to, polyamine, polylysine, polyalkylenimine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

In one embodiment, pharmaceutical compositions of the present invention may include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include modified nucleic acids, enhanced modified RNA or ribonucleic acids with phosphorothioate backbones and oligonucleosides with other modified backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucleotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$OCH$_3$, O($CH_2$)$_n$NH$_2$, O($CH_2$)$_n$$CH_3$, O($CH_2$)$_n$ONH$_2$, and O($CH_2$)$_n$ON[($CH_2$)$_n$$CH_3$)]$_2$, where n and m are from 1 to about 10. In other embodiments, the modified nucleic acids, enhanced modified RNA or ribonucleic acids include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-β-dimethylaminoethoxyethyl or 2'-DMAEOE), i.e., 2'-O—CH$_2$—O—CH$_2$—N(CH$_3$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. Polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920 and each of which is herein incorporated by reference.

In still other embodiments, the polynucleotides, modified nucleic acids, enhanced modified RNA or ribonucleic acids is covalently conjugated to a cell penetrating polypeptide. The cell-penetrating peptide may also include a signal sequence. The conjugates of the invention can be designed to have increased stability; increased cell transfection; and/or altered the biodistribution (e.g., targeted to specific tissues or cell types).

Self-Assembled Nucleic Acid Nanoparticles

Self-assembled nanoparticles have a well-defined size which may be precisely controlled as the nucleic acid strands may be easily reprogrammable. For example, the optimal particle size for a cancer-targeting nanodelivery carrier is 20-100 nm as a diameter greater than 20 nm avoids renal clearance and enhances delivery to certain tumors through enhanced permeability and retention effect. Using self-assembled nucleic acid nanoparticles a single uniform population in size and shape having a precisely controlled spatial orientation and density of cancer-targeting ligands for enhanced delivery. As a non-limiting example, oligonucleotide nanoparticles were prepared using programmable self-assembly of short DNA fragments and therapeutic siRNAs. These nanoparticles are molecularly identical with controllable particle size and target ligand location and density. The DNA fragments and siRNAs self-assembled into a one-step reaction to generate DNA/siRNA tetrahedral nanoparticles for targeted in vivo delivery. (Lee et al., Nature Nanotechnology 2012 7:389-393).

Excipients

Pharmaceutical formulations may additionally comprise a pharmaceutically acceptable excipient, which, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Various excipients for formulating pharmaceutical compositions and techniques for preparing the composition are known in the art (see *Remington: The Science and Practice of Pharmacy*, 21$^{st}$ Edition, A. R. Gennaro, Lippincott, Williams & Wilkins, Baltimore, Md., 2006; incorporated herein by reference). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, a pharmaceutically acceptable excipient may be at least 95%, at least 96%, at least 97%, at least 98%, at least 99%, or 100% pure. In some embodiments, an excipient may be approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical formulations. The composition may also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (Veegum), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate [Span®60], sorbitan tristearate [Span®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly (vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER® 188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate)(VEEGUM®, and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Exemplary antioxidants include, but are not limited to, alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL® 115, GERMABEN®II, NEOLONE™, KATHON™, and/or EUXYL®.

Exemplary buffering agents include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, d-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Delivery

The present disclosure encompasses the delivery of polynucleotides, modified nucleic acids, enhanced modified RNA or ribonucleic acids for any of therapeutic, pharmaceutical, diagnostic or imaging by any appropriate route taking into consideration likely advances in the sciences of drug delivery. Delivery may be naked or formulated.

Naked Delivery

The polynucleotides, modified nucleic acids, enhanced modified RNA or ribonucleic acids of the present invention may be delivered to a cell naked. As used herein in, "naked" refers to delivering polynucleotides, modified nucleic acids, enhanced modified RNA or ribonucleic acids free from agents which promote transfection. For example, the polynucleotides, modified nucleic acids, enhanced modified RNA or ribonucleic acids delivered to the cell may contain no modifications. The naked polynucleotides, modified nucleic acids, enhanced modified RNA or ribonucleic acids may be delivered to the cell using routes of administration known in the art and described herein.

Formulated Delivery

The polynucleotides, modified nucleic acids, enhanced modified RNA or ribonucleic acids of the present invention may be formulated, using the methods described herein. The formulations may contain polynucleotides, modified nucleic acids, enhanced modified RNA or ribonucleic acids which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated polynucleotides, modified nucleic acids or enhanced modified nucleic acids may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

In certain embodiments, the formulations include one or more cell penetration agents, e.g., transfection agents. In one specific embodiment, a ribonucleic acid is mixed or admixed with a transfection agent (or mixture thereof) and the resulting mixture is employed to transfect cells. Preferred transfection agents are cationic lipid compositions, particularly monovalent and polyvalent cationic lipid compositions, more particularly "LIPOFECTIN," "LIPOFECTACE,"

"LIPOFECTAMINE," "CELLFECTIN," DMRIE-C, DMRIE, DOTAP, DOSPA, and DOSPER, and dendrimer compositions, particularly G5-G10 dendrimers, including dense star dendrimers, PAMAM dendrimers, grafted dendrimers, and dendrimers known as dendrigrafts and "SUPERFECT." In a second specific transfection method, a ribonucleic acid is conjugated to a nucleic acid-binding group, for example a polyamine and more particularly a spermine, which is then introduced into the cell or admixed with a transfection agent (or mixture thereof) and the resulting mixture is employed to transfect cells. In a third specific embodiment, a mixture of one or more transfection-enhancing peptides, proteins, or protein fragments, including fusagenic peptides or proteins, transport or trafficking peptides or proteins, receptor-ligand peptides or proteins, or nuclear localization peptides or proteins and/or their modified analogs (e.g., spermine modified peptides or proteins) or combinations thereof are mixed with and complexed with a ribonucleic acid to be introduced into a cell, optionally being admixed with transfection agent and the resulting mixture is employed to transfect cells. Further, a component of a transfection agent (e.g., lipids, cationic lipids or dendrimers) is covalently conjugated to selected peptides, proteins, or protein fragments directly or via a linking or spacer group. Of particular interest in this embodiment are peptides or proteins that are fusagenic, membrane-permeabilizing, transport or trafficking, or which function for cell-targeting. The peptide- or protein-transfection agent complex is combined with a ribonucleic acid and employed for transfection.

In certain embodiments, the formulations include a pharmaceutically acceptable carrier that causes the effective amount of polynucleotide, modified nucleic acid, or ribonucleic acid to be substantially retained in a target tissue containing the cell.

Administration

The polynucleotides, modified nucleic acids, enhanced modified RNA or ribonucleic acids of the present invention may be administered by any route which results in a therapeutically effective outcome. These include, but are not limited to enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops.

In one embodiment, provided are compositions for generation of an in vivo depot containing a polynucleotide, modified nucleic acid or engineered ribonucleotide. For example, the composition contains a bioerodible, biocompatible polymer, a solvent present in an amount effective to plasticize the polymer and form a gel therewith, and a polynucleotide, modified nucleic acid or engineered ribonucleic acid. In certain embodiments the composition also includes a cell penetration agent as described herein. In other embodiments, the composition also contains a thixotropic amount of a thixotropic agent mixable with the polymer so as to be effective to form a thixotropic composition. Further compositions include a stabilizing agent, a bulking agent, a chelating agent, or a buffering agent.

In other embodiments, provided are sustained-release delivery depots, such as for administration of a polynucleotide, modified nucleic acid, or engineered ribonucleic acid an environment (meaning an organ or tissue site) in a patient. Such depots generally contain an engineered ribonucleic acid and a flexible chain polymer where both the engineered ribonucleic acid and the flexible chain polymer are entrapped within a porous matrix of a crosslinked matrix protein. Usually, the pore size is less than 1 mm, such as 900 nm, 800 nm, 700 nm, 600 nm, 500 nm, 400 nm, 300 nm, 200 nm, 100 nm, or less than 100 nm. Usually the flexible chain polymer is hydrophilic. Usually the flexible chain polymer has a molecular weight of at least 50 kDa, such as 75 kDa, 100 kDa, 150 kDa, 200 kDa, 250 kDa, 300 kDa, 400 kDa, 500 kDa, or greater than 500 kDa. Usually the flexible chain polymer has a persistence length of less than 10%, such as 9, 8, 7, 6, 5, 4, 3, 2, 1 or less than 1% of the persistence length of the matrix protein. Usually the flexible chain polymer has a charge similar to that of the matrix protein. In some embodiments, the flexible chain polymer alters the effective pore size of a matrix of crosslinked matrix protein to a size capable of sustaining the diffusion of the engineered ribonucleic acid from the matrix into a surrounding tissue comprising a cell into which the polynucleotide, modified nucleic acid, engineered ribonucleic acid is capable of entering.

In specific embodiments, compositions may be administered in a way which allows them cross the blood-brain barrier, vascular barrier, or other epithelial barrier. Non-limiting routes of administration for the polynucleotides, modified nucleic acids, enhanced modified RNA or ribonucleic acids of the present invention are described below.

The present invention provides methods comprising administering polynucleotides, modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention will be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

Parenteral and Injectable Administration

Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, compositions containing the polynucleotides, modified nucleic acids, enhanced modified RNA or ribonucleic acids of the invention may be formulated for administration topically. The skin may be an ideal target site for delivery as it is readily accessible. Gene expression may be restricted not only to the skin, potentially avoiding nonspecific toxicity, but also to specific layers and cell types within the skin.

The site of cutaneous expression of the delivered compositions will depend on the route of nucleic acid delivery. Three routes are commonly considered to deliver polynucleotides, modified nucleic acids, enhanced modified RNA or ribonucleic acids to the skin: (i) topical application (e.g. for local/regional treatment); (ii) intradermal injection (e.g. for local/regional treatment); and (iii) systemic delivery (e.g. for treatment of dermatologic diseases that affect both cutaneous and extracutaneous regions). Polynucleotides, modified nucleic acids, enhanced modified RNA or ribonucleic acids can be delivered to the skin by several different approaches known in the art. Most topical delivery approaches have been shown to work for delivery of DNA, such as but not limited to, topical application of non-cationic liposome-DNA complex, cationic liposome-DNA complex, particle-mediated (gene gun), puncture-mediated gene transfections, and viral delivery approaches. After delivery of the nucleic acid, gene products have been detected in a number of different skin cell types, including, but not limited to, basal keratinocytes, sebaceous gland cells, dermal fibroblasts and dermal macrophages.

In one embodiment, the invention provides for a variety of dressings (e.g., wound dressings) or bandages (e.g., adhesive bandages) for conveniently and/or effectively carrying out methods of the present invention. Typically dressing or bandages may comprise sufficient amounts of pharmaceutical compositions and/or polynucleotides, modified nucleic acids, enhanced modified RNA or ribonucleic acids described herein to allow a user to perform multiple treatments of a subject(s).

In one embodiment, the invention provides for the polynucleotides, modified nucleic acids, enhanced modified RNA or ribonucleic acids compositions to be delivered in more than one injection.

In one embodiment, before topical and/or transdermal administration at least one area of tissue, such as skin, may be subjected to a device and/or solution which may increase permeability. In one embodiment, the tissue may be subjected to an abrasion device to increase the permeability of the skin (see U.S. Patent Publication No. 20080275468, herein incorporated by reference in its entirety). In another embodiment, the tissue may be subjected to an ultrasound enhancement device. An ultrasound enhancement device may include, but is not limited to, the devices described in U.S. Publication No. 20040236268 and U.S. Pat. Nos. 6,491,657 and 6,234,990; each of which are herein incorporated by reference in their entireties. Methods of enhancing the permeability of tissue are described in U.S. Publication Nos. 20040171980 and 20040236268 and U.S. Pat. No. 6,190,315; each of which are herein incorporated by reference in their entireties.

In one embodiment, a device may be used to increase permeability of tissue before delivering formulations of modified mRNA described herein. The permeability of skin may be measured by methods known in the art and/or described in U.S. Pat. No. 6,190,315, herein incorporated by reference in its entirety. As a non-limiting example, a modified mRNA formulation may be delivered by the drug delivery methods described in U.S. Pat. No. 6,190,315, herein incorporated by reference in its entirety.

In another non-limiting example tissue may be treated with a eutectic mixture of local anesthetics (EMLA) cream before, during and/or after the tissue may be subjected to a device which may increase permeability. Katz et al. (Anesth Analg (2004); 98:371-76; herein incorporated by reference in its entirety) showed that using the EMLA cream in combination with a low energy, an onset of superficial cutaneous analgesia was seen as fast as 5 minutes after a pretreatment with a low energy ultrasound.

In one embodiment, enhancers may be applied to the tissue before, during, and/or after the tissue has been treated to increase permeability. Enhancers include, but are not limited to, transport enhancers, physical enhancers, and cavitation enhancers. Non-limiting examples of enhancers are described in U.S. Pat. No. 6,190,315, herein incorporated by reference in its entirety.

In one embodiment, a device may be used to increase permeability of tissue before delivering formulations of modified mRNA described herein, which may further contain a substance that invokes an immune response. In another non-limiting example, a formulation containing a substance to invoke an immune response may be delivered by the methods described in U.S. Publication Nos. 20040171980 and 20040236268; each of which are herein incorporated by reference in their entireties.

Dosage forms for topical and/or transdermal administration of a composition may include ointments, pastes, creams, lotions, gels, powders, solutions, sprays, inhalants and/or patches. Generally, an active ingredient is admixed under sterile conditions with a pharmaceutically acceptable excipient and/or any needed preservatives and/or buffers as may be required. Additionally, the present invention contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 0.1% to about 10% (w/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, the composition is formulated in depots for extended release. Generally, a specific organ or tissue (a "target tissue") is targeted for administration.

In some aspects of the invention, the nucleic acids (particularly ribonucleic acids encoding polypeptides) are spatially retained within or proximal to a target tissue. Provided are method of providing a composition to a target tissue of a mammalian subject by contacting the target tissue (which contains one or more target cells) with the composition under conditions such that the composition, in particular the nucleic acid component(s) of the composition, is substantially retained in the target tissue, meaning that at least 10, 20, 30, 40, 50, 60, 70, 80, 85, 90, 95, 96, 97, 98, 99, 99.9, 99.99 or greater than 99.99% of the composition is retained in the target tissue. Advantageously, retention is determined by measuring the amount of the nucleic acid present in the composition that enters one or more target cells. For example, at least 1, 5, 10, 20, 30, 40, 50, 60, 70, 80, 85, 90, 95, 96, 97, 98, 99, 99.9, 99.99 or greater than 99.99% of the nucleic acids administered to the subject are present intracellularly at a period of time following administration. For example, intramuscular injection to a mammalian subject is performed using an aqueous composition containing a ribonucleic acid and a transfection reagent, and retention of the composition is determined by measuring the amount of the ribonucleic acid present in the muscle cells.

Aspects of the invention are directed to methods of providing a composition to a target tissue of a mammalian subject, by contacting the target tissue (containing one or more target cells) with the composition under conditions such that the composition is substantially retained in the target tissue. In another embodiment, a polynucleotide, ribonucleic acid engineered to avoid an innate immune response of a cell into which the ribonucleic acid enters, where the ribonucleic acid contains a nucleotide sequence encoding a polypeptide of interest, under conditions such that the polypeptide of interest is produced in at least one target cell. The compositions generally contain a cell penetration agent, although "naked" nucleic acid (such as nucleic acids without a cell penetration agent or other agent) is also contemplated, and a pharmaceutically acceptable carrier.

In some circumstances, the amount of a protein produced by cells in a tissue is desirably increased. Preferably, this increase in protein production is spatially restricted to cells within the target tissue. Thus, provided are methods of increasing production of a protein of interest in a tissue of a mammalian subject. A composition is provided that contains a ribonucleic acid that is engineered to avoid an innate immune response of a cell into which the ribonucleic acid enters and encodes the polypeptide of interest and the composition is characterized in that a unit quantity of composition has been determined to produce the polypeptide of interest in a substantial percentage of cells contained within a predetermined volume of the target tissue.

In some embodiments, the composition includes a plurality of different ribonucleic acids, where one or more than one of the ribonucleic acids is engineered to avoid an innate immune response of a cell into which the ribonucleic acid enters, and where one or more than one of the ribonucleic acids encodes a polypeptide of interest. Optionally, the composition also contains a cell penetration agent to assist in the intracellular delivery of the ribonucleic acid. A determination is made of the dose of the composition required to produce the polypeptide of interest in a substantial percentage of cells contained within the predetermined volume of the target tissue (generally, without inducing significant production of the polypeptide of interest in tissue adjacent to the predetermined volume, or distally to the target tissue). Subsequent to this determination, the determined dose is introduced directly into the tissue of the mammalian subject.

In one embodiment, the invention provides for the polynucleotides, modified nucleic acids, enhanced modified RNA or ribonucleic acids to be delivered in more than one injection or by split dose injections.

In one embodiment, the invention may be retained near target tissue using a small disposable drug reservoir or patch pump. Non-limiting examples of patch pumps include those manufactured and/or sold by BD®, (Franklin Lakes, N.J.), Insulet Corporation (Bedford, Mass.), SteadyMed Therapeutics (San Francisco, Calif.), Medtronic (Minneapolis, Minn.), UniLife (York, Pa.), Valeritas (Bridgewater, N.J.), and SpringLeaf Therapeutics (Boston, Mass.).

Pulmonary Administration

A pharmaceutical composition may be prepared, packaged, and/or sold in a formulation suitable for pulmonary administration via the buccal cavity. Such a formulation may comprise dry particles which comprise the active ingredient and which have a diameter in the range from about 0.5 nm to about 7 nm or from about 1 nm to about 6 nm. Such compositions are suitably in the form of dry powders for administration using a device comprising a dry powder reservoir to which a stream of propellant may be directed to disperse the powder and/or using a self propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nm and at least 95% of the particles by number have a diameter less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50% to 99.9% (w/w) of the composition, and active ingredient may constitute 0.1% to 20% (w/w) of the composition. A propellant may further comprise additional ingredients such as a liquid non-ionic and/or solid anionic surfactant and/or a solid diluent (which may have a particle size of the same order as particles comprising the active ingredient).

Pharmaceutical compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

Formulations described herein as being useful for pulmonary delivery are useful for intranasal delivery of a pharmaceutical composition. Another formulation suitable for intranasal administration is a coarse powder comprising the active ingredient and having an average particle from about 0.2 μm to 500 μm. Such a formulation is administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein Ophthalmic Administration A pharmaceutical composition may be prepared, packaged, and/or sold in a formulation suitable for ophthalmic administration. Such formulations may, for example, be in the form of eye drops including, for example, a 0.1/1.0% (w/w) solution and/or suspension of the active ingredient in an aqueous or oily liquid excipient. Such drops may further comprise buffering agents, salts, and/or one or more other of any additional ingredients described herein. Other ophthalmically-administrable formulations which are useful include those which comprise the active ingredient in microcrystalline form and/or in a liposomal preparation. Ear drops and/or eye drops are contemplated as being within the scope of this invention.

Payload Administration: Detectable Agents and Therapeutic Agents

The polynucleotides, modified nucleic acids, enhanced modified RNA or ribonucleic acids described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

The polynucleotides, modified nucleic acids, enhanced modified RNA or ribonucleic acids can be designed to include both a linker and a payload in any useful orientation. For example, a linker having two ends is used to attach one end to the payload and the other end to the nucleobase, such as at the C-7 or C-8 positions of the deaza-adenosine or deaza-guanosine or to the N-3 or C-5 positions of cytosine or uracil. The polynucleotide of the invention can include more than one payload (e.g., a label and a transcription inhibitor), as well as a cleavable linker.

In one embodiment, the modified nucleotide is a modified 7-deaza-adenosine triphosphate, where one end of a cleavable linker is attached to the C7 position of 7-deaza-adenine, the other end of the linker is attached to an inhibitor (e.g., to the C5 position of the nucleobase on a cytidine), and a label (e.g., Cy5) is attached to the center of the linker (see, e.g., compound 1 of A*pCp C5 Parg Capless in FIG. 5 and columns 9 and 10 of U.S. Pat. No. 7,994,304, incorporated herein by reference). Upon incorporation of the modified 7-deaza-adenosine triphosphate to an encoding region, the resulting polynucleotide having a cleavable linker attached to a label and an inhibitor (e.g., a polymerase inhibitor). Upon cleavage of the linker (e.g., with reductive conditions to reduce a linker having a cleavable disulfide moiety), the label and inhibitor are released. Additional linkers and payloads (e.g., therapeutic agents, detectable labels, and cell penetrating payloads) are described herein.

For example, the polynucleotides, modified nucleic acids, enhanced modified RNA or ribonucleic acids described herein can be used in reprogramming induced pluripotent stem cells (iPS cells), which can directly track cells that are transfected compared to total cells in the cluster. In another example, a drug that may be attached to the modified nucleic acids, enhanced modified RNA or ribonucleic acids via a linker and may be fluorescently labeled can be used to track the drug in vivo, e.g. intracellularly. Other examples include, but are not limited to, the use of polynucleotides, modified nucleic acids, enhanced modified RNA or ribonucleic acids in reversible drug delivery into cells.

The polynucleotides, modified nucleic acids, enhanced modified RNA or ribonucleic acids described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In addition, the polynucleotides, modified nucleic acids, enhanced modified RNA or ribonucleic acids described herein can be used to deliver therapeutic agents to cells or tissues, e.g., in living animals. For example, the polynucleotides, modified nucleic acids, enhanced modified RNA or ribonucleic acids described herein can be used to deliver highly polar chemotherapeutics agents to kill cancer cells. The polynucleotides, modified nucleic acids, enhanced modified RNA or ribonucleic acids attached to the therapeutic agent through a linker can facilitate member permeation allowing the therapeutic agent to travel into a cell to reach an intracellular target.

In another example, the polynucleotides, modified nucleic acids, enhanced modified RNA or ribonucleic acids can be attached to the polynucleotides, modified nucleic acids, enhanced modified RNA or ribonucleic acids a viral inhibitory peptide (VIP) through a cleavable linker. The cleavable linker can release the VIP and dye into the cell. In another example, the polynucleotides, modified nucleic acids, enhanced modified RNA or ribonucleic acids can be attached through the linker to an ADP-ribosylate, which is responsible for the actions of some bacterial toxins, such as cholera toxin, diphtheria toxin, and pertussis toxin. These toxin proteins are ADP-ribosyltransferases that modify target proteins in human cells. For example, cholera toxin ADP-ribosylates G proteins modifies human cells by causing massive fluid secretion from the lining of the small intestine, which results in life-threatening diarrhea.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$KR, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate (VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexyl), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5'5''-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine(1:1) (IR144); 5-chloro-2-[2-[3-[(5-chloro-3-ethyl-2(3H)-benzothiazol-ylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (Cibacron™ Brilliant Red 3B-A); rhodamine and derivatives (e.g., 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine In some embodiments, the detectable agent may be a non-detectable pre-cursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis. Combination The modified nucleic acids, enhanced modified RNA or ribonucleic acids may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body. As a non-limiting example, the modified nucleic acids, enhanced modified RNA or ribonucleic acids may be used in combination with a pharmaceutical agent for the treatment of cancer or to control hyperproliferative cells. In U.S. Pat. No. 7,964,571, herein incorporated by reference in its entirety, a combination therapy for the treatment of solid primary or metastasized tumor is described using a pharmaceutical composition including a DNA plasmid encoding for interleukin-12 with a lipopolymer and also administering at least one anticancer agent or chemotherapeutic. Further, the modified nucleic acids, enhanced modified RNA or ribonucleic acids of the present invention that encodes anti-proliferative molecules may be in a pharmaceutical composition with a lipopolymer (see e.g., U.S. Pub. No. 20110218231, herein incorporated by reference in its entirety, claiming a pharmaceutical composition comprising a DNA plasmid encoding an anti-proliferative molecule and a lipopolymer) which may be administered with at least one chemotherapeutic or anticancer agent.

Payload Administration: Cell Penetrating Payload

In some embodiments, the polynucleotides, modified nucleotides and modified nucleic acid molecules, which are incorporated into a nucleic acid, e.g., RNA or mRNA, can also include a payload that can be a cell penetrating moiety or agent that enhances intracellular delivery of the compositions. For example, the compositions can include, but are not limited to, a cell-penetrating peptide sequence that facilitates delivery to the intracellular space, e.g., HIV-derived TAT peptide, penetratins, transportans, or hCT derived cell-penetrating peptides, see, e.g., Caron et al., (2001) Mol. Ther. 3(3):310-8; Langel, Cell-Penetrating Peptides: Processes and Applications (CRC Press, Boca Raton Fla. 2002); El-Andaloussi et al., (2005) Curr Pharm Des. 11(28):3597-611; and Deshayes et al., (2005) Cell Mol Life Sci. 62(16):1839-49; all of which are incorporated herein by reference. The compositions can also be formulated to include a cell penetrating agent, e.g., liposomes, which enhance delivery of the compositions to the intracellular space.

Payload Administration: Biological Target

The modified nucleotides and modified nucleic acid molecules described herein, which are incorporated into a nucleic acid, e.g., RNA or mRNA, can be used to deliver a payload to any biological target for which a specific ligand exists or can be generated. The ligand can bind to the biological target either covalently or non-covalently.

Examples of biological targets include, but are not limited to, biopolymers, e.g., antibodies, nucleic acids such as RNA and DNA, proteins, enzymes; examples of proteins include, but are not limited to, enzymes, receptors, and ion channels. In some embodiments the target may be a tissue- or a cell-type specific marker, e.g., a protein that is expressed specifically on a selected tissue or cell type. In some embodiments, the target may be a receptor, such as, but not limited to, plasma membrane receptors and nuclear receptors; more specific examples include, but are not limited to, G-protein-coupled receptors, cell pore proteins, transporter proteins, surface-expressed antibodies, HLA proteins, MHC proteins and growth factor receptors.

Dosing

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations).

According to the present invention, it has been discovered that administration of modified nucleic acids, enhanced modified RNA or ribonucleic acids in split-dose regimens produce higher levels of proteins in mammalian subjects. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the modified nucleic acids, enhanced modified RNA or ribonucleic acids of the present invention are administered to a subject in split doses. The modified nucleic acids, enhanced modified RNA or ribonucleic acids may be formulated in buffer only or in a formulation described herein.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of modified mRNA then depends upon its rate of dissolution which, in turn, may depend upon crystal size and crystalline form. Alternatively, delayed absorption of a parenterally administered modified mRNA may be accomplished by dissolving or suspending the modified mRNA in an oil vehicle. Injectable depot forms are made by forming microencapsule matrices of the modified mRNA in biodegradable polymers such as polylactide-polyglycolide. Depending upon the ratio of modified mRNA to polymer and the nature of the particular polymer employed, the rate of modified mRNA release can be controlled. Examples of other biodegradable polymers include, but are not limited to, poly(orthoesters) and poly (anhydrides). Depot injectable formulations may be prepared by entrapping the modified mRNA in liposomes or microemulsions which are compatible with body tissues.

Pulmonary

Formulations described herein as being useful for pulmonary delivery may also be use for intranasal delivery of a pharmaceutical composition. Another formulation suitable for intranasal administration may be a coarse powder comprising the active ingredient and having an average particle from about 0.2 µm to 500 µm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference in its entirety).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits for protein production, comprising a first modified nucleic acids, enhanced modified RNA or ribonucleic acids comprising a translatable region. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium. In a further embodiment, the buffer solutions may be precipitated or it may be lyophilized. The amount of each component may be varied to enable consistent, reproducible higher concentration saline or simple buffer formulations. The components may also be varied in order to increase the stability of modified RNA in the buffer solution over a period of time and/or under a variety of conditions.

In one aspect, the present invention provides kits for protein production, comprising: a modified nucleic acids, enhanced modified RNA or ribonucleic acids comprising a translatable region, provided in an amount effective to produce a desired amount of a protein encoded by the translatable region when introduced into a target cell; a second modified nucleic acids, enhanced modified RNA or ribonucleic acids comprising an inhibitory nucleic acid, provided in an amount effective to substantially inhibit the innate immune response of the cell; and packaging and instructions.

In one aspect, the present invention provides kits for protein production, comprising a modified nucleic acids, enhanced modified RNA or ribonucleic acids comprising a translatable region, wherein the nucleic acid exhibits reduced degradation by a cellular nuclease, and packaging and instructions.

In one aspect, the present invention provides kits for protein production, comprising a modified nucleic acids, enhanced modified RNA or ribonucleic acids comprising a translatable region, wherein the nucleic acid exhibits reduced degradation by a cellular nuclease, and a mammalian cell suitable for translation of the translatable region of the first nucleic acid Devices The present invention provides for devices which may incorporate modified nucleic acids, enhanced modified RNA or ribonucleic acids that encode polypeptides of interest. These devices contain in a stable formulation the reagents to synthesize a nucleic acid in a formulation available to be immediately delivered to a subject in need thereof, such as a human patient. Non-limiting examples of such a polypeptide of interest include a growth factor and/or angiogenesis stimulator for wound healing, a peptide antibiotic to facilitate infection control, and an antigen to rapidly stimulate an immune response to a newly identified virus.

In some embodiments the device is self-contained, and is optionally capable of wireless remote access to obtain instructions for synthesis and/or analysis of the generated modified nucleic acids, enhanced modified RNA or ribonucleic acids. The device is capable of mobile synthesis of at least one modified nucleic acids, enhanced modified RNA or ribonucleic acids and preferably an unlimited number of different modified nucleic acids, enhanced modified RNA or ribonucleic acids. In certain embodiments, the device is capable of being transported by one or a small number of individuals. In other embodiments, the device is scaled to fit on a benchtop or desk. In other embodiments, the device is scaled to fit into a suitcase, backpack or similarly sized object. In another embodiment, the device may be a point of care or handheld device. In further embodiments, the device is scaled to fit into a vehicle, such as a car, truck or ambulance, or a military vehicle such as a tank or personnel carrier. The information necessary to generate a ribonucleic acid encoding polypeptide of interest is present within a computer readable medium present in the device.

In one embodiment, a device may be used to assess levels of a protein which has been administered in the form of a modified nucleic acids, enhanced modified RNA or ribonucleic acids. The device may comprise a blood, urine or other biofluidic test.

In some embodiments, the device is capable of communication (e.g., wireless communication) with a database of nucleic acid and polypeptide sequences. The device contains at least one sample block for insertion of one or more sample vessels. Such sample vessels are capable of accepting in liquid or other form any number of materials such as template DNA, nucleotides, enzymes, buffers, and other reagents. The sample vessels are also capable of being heated and cooled by contact with the sample block. The sample block is generally in communication with a device base with one or more electronic control units for the at least one sample block. The sample block preferably contains a heating module, such heating molecule capable of heating and/or cooling the sample vessels and contents thereof to temperatures between about −20 C and above +100 C. The device base is in communication with a voltage supply such as a battery or external voltage supply. The device also contains means for storing and distributing the materials for RNA synthesis.

Optionally, the sample block contains a module for separating the synthesized nucleic acids. Alternatively, the device contains a separation module operably linked to the sample block. Preferably the device contains a means for analysis of the synthesized nucleic acid. Such analysis includes sequence identity (demonstrated such as by hybridization), absence of non-desired sequences, measurement of integrity of synthesized mRNA (such has by microfluidic viscometry combined with spectrophotometry), and concentration and/or potency of modified nucleic acids, enhanced modified RNA or ribonucleic acids (such as by spectrophotometry).

In certain embodiments, the device is combined with a means for detection of pathogens present in a biological material obtained from a subject, e.g., the IBIS PLEX-ID system (Abbott, Abbott Park, Ill.) for microbial identification.

Suitable devices for use in delivering intradermal pharmaceutical compositions described herein include short needle devices such as those described in U.S. Pat. Nos. 4,886,499; 5,190,521; 5,328,483; 5,527,288; 4,270,537; 5,015,235; 5,141,496; and 5,417,662. Intradermal compositions may be administered by devices which limit the effective penetration length of a needle into the skin, such as those described in PCT publication WO 99/34850 and functional equivalents thereof. Jet injection devices which deliver liquid compositions to the dermis via a liquid jet injector and/or via a needle which pierces the stratum corneum and produces a jet which reaches the dermis are suitable. Jet injection devices are described, for example, in U.S. Pat. Nos. 5,480,381; 5,599,302; 5,334,144; 5,993,412; 5,649,912; 5,569,189; 5,704,911; 5,383,851; 5,893,397; 5,466,220; 5,339,163; 5,312,335; 5,503,627; 5,064,413; 5,520,639; 4,596,556; 4,790,824; 4,941,880; 4,940,460; and PCT publications WO 97/37705 and WO 97/13537. Ballistic powder/particle delivery devices which use compressed gas to accelerate vaccine in powder form through the outer layers of the skin to the dermis are suitable.

Alternatively or additionally, conventional syringes may be used in the classical mantoux method of intradermal administration.

In some embodiments, the device may be a pump or comprise a catheter for administration of compounds or compositions of the invention across the blood brain barrier. Such devices include but are not limited to a pressurized olfactory delivery device, iontophoresis devices, multi-layered microfluidic devices, and the like. Such devices may be portable or stationary. They may be implantable or externally tethered to the body or combinations thereof.

Devices for administration may be employed to deliver the modified nucleic acids, enhanced modified RNA or ribonucleic acids of the present invention according to single, multi- or split-dosing regimens taught herein. Such devices are described below.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices may be utilized to deliver the single, multi- or split doses contemplated herein.

A method for delivering therapeutic agents to a solid tissue has been described by Bahrami et al. and is taught for example in US Patent Publication 20110230839, the contents of which are incorporated herein by reference in their entirety. According to Bahrami, an array of needles is incorporated into a device which delivers a substantially equal amount of fluid at any location in said solid tissue along each needle's length.

A device for delivery of biological material across the biological tissue has been described by Kodgule et al. and is taught for example in US Patent Publication 20110172610, the contents of which are incorporated herein by reference in their entirety. According to Kodgule, multiple hollow microneedles made of one or more metals and having outer diameters from about 200 microns to about 350 microns and lengths of at least 100 microns are incorporated into the device which delivers peptides, proteins, carbohydrates, nucleic acid molecules, lipids and other pharmaceutically active ingredients or combinations thereof.

A delivery probe for delivering a therapeutic agent to a tissue has been described by Gunday et al. and is taught for example in US Patent Publication 20110270184, the contents of which are incorporated herein by reference in their entirety. According to Gunday, multiple needles are incorporated into the device which moves the attached capsules between an activated position and an inactivated position to force the agent out of the capsules through the needles.

A multiple-injection medical apparatus has been described by Assaf and is taught for example in US Patent Publication 20110218497, the contents of which are incorporated herein by reference in their entirety. According to Assaf, multiple needles are incorporated into the device which has a chamber connected to one or more of said needles and a means for continuously refilling the chamber with the medical fluid after each injection.

In one embodiment, the modified nucleic acids, enhanced modified RNA or ribonucleic acids are administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period). The split doses can be administered simultaneously to adjacent tissue using the devices described in U.S. Patent Publication Nos. 20110230839 and 20110218497, each of which is incorporated herein by reference.

An at least partially implantable system for injecting a substance into a patient's body, in particular a penis erection stimulation system has been described by Forsell and is taught for example in US Patent Publication 20110196198, the contents of which are incorporated herein by reference in their entirety. According to Forsell, multiple needles are incorporated into the device which is implanted along with one or more housings adjacent the patient's left and right corpora cavernosa. A reservoir and a pump are also implanted to supply drugs through the needles.

A method for the transdermal delivery of a therapeutic effective amount of iron has been described by Berenson and is taught for example in US Patent Publication 20100130910, the contents of which are incorporated herein by reference in their entirety. According to Berenson, multiple needles may be used to create multiple micro channels in stratum corneum to enhance transdermal delivery of the ionic iron on an iontophoretic patch.

A method for delivery of biological material across the biological tissue has been described by Kodgule et al and is taught for example in US Patent Publication 20110196308, the contents of which are incorporated herein by reference in their entirety. According to Kodgule, multiple biodegradable microneedles containing a therapeutic active ingredient are incorporated in a device which delivers proteins, carbohydrates, nucleic acid molecules, lipids and other pharmaceutically active ingredients or combinations thereof.

A transdermal patch comprising a botulinum toxin composition has been described by Donovan and is taught for example in US Patent Publication 20080220020, the contents of which are incorporated herein by reference in their entirety. According to Donovan, multiple needles are incorporated into the patch which delivers botulinum toxin under stratum corneum through said needles which project through the stratum corneum of the skin without rupturing a blood vessel.

A small, disposable drug reservoir, or patch pump, which can hold approximately 0.2 to 15 mL of liquid formulations can be placed on the skin and deliver the formulation continuously subcutaneously using a small bore needed (e.g., 26 to 34 gauge). As non-limiting examples, the patch pump may be 50 mm by 76 mm by 20 mm spring loaded having a 30 to 34 gauge needle (BD™ Microinfuser, Franklin Lakes N.J.), 41 mm by 62 mm by 17 mm with a 2 mL reservoir used for drug delivery such as insulin (OMNIPOD®, Insulet Corporation Bedford, Mass.), or 43-60 mm diameter, 10 mm thick with a 0.5 to 10 mL reservoir (PATCHPUMP®, SteadyMed Therapeutics, San Francisco, Calif.). Further, the patch pump may be battery powered and/or rechargeable.

A cryoprobe for administration of an active agent to a location of cryogenic treatment has been described by Toubia and is taught for example in US Patent Publication 20080140061, the contents of which are incorporated herein by reference in their entirety. According to Toubia, multiple needles are incorporated into the probe which receives the active agent into a chamber and administers the agent to the tissue.

A method for treating or preventing inflammation or promoting healthy joints has been described by Stock et al and is taught for example in US Patent Publication 20090155186, the contents of which are incorporated herein by reference in their entirety. According to Stock, multiple needles are incorporated in a device which administers compositions containing signal transduction modulator compounds.

A multi-site injection system has been described by Kimmell et al. and is taught for example in US Patent Publication 20100256594, the contents of which are incorporated herein by reference in their entirety. According to Kimmell, multiple needles are incorporated into a device which delivers a medication into a stratum corneum through the needles.

A method for delivering interferons to the intradermal compartment has been described by Dekker et al. and is taught for example in US Patent Publication 20050181033, the contents of which are incorporated herein by reference in their entirety. According to Dekker, multiple needles having an outlet with an exposed height between 0 and 1 mm are incorporated into a device which improves pharmacokinetics and bioavailability by delivering the substance at a depth between 0.3 mm and 2 mm.

A method for delivering genes, enzymes and biological agents to tissue cells has described by Desai and is taught for example in US Patent Publication 20030073908, the contents of which are incorporated herein by reference in their entirety. According to Desai, multiple needles are incorporated into a device which is inserted into a body and delivers a medication fluid through said needles.

A method for treating cardiac arrhythmias with fibroblast cells has been described by Lee et al and is taught for example in US Patent Publication 20040005295, the contents of which are incorporated herein by reference in their entirety. According to Lee, multiple needles are incorporated into the device which delivers fibroblast cells into the local region of the tissue.

A method using a magnetically controlled pump for treating a brain tumor has been described by Shachar et al. and is taught for example in U.S. Pat. No. 7,799,012 (method) and U.S. Pat. No. 7,799,016 (device), the contents of which are incorporated herein by reference in their entirety. According Shachar, multiple needles were incorporated into the pump which pushes a medicating agent through the needles at a controlled rate.

Methods of treating functional disorders of the bladder in mammalian females have been described by Versi et al. and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A micro-needle transdermal transport device has been described by Angel et al and is taught for example in U.S. Pat. No. 7,364,568, the contents of which are incorporated herein by reference in their entirety. According to Angel, multiple needles are incorporated into the device which transports a substance into a body surface through the needles which are inserted into the surface from different directions. The micro-needle transdermal transport device may be a solid micro-needle system or a hollow micro-needle system. As a non-limiting example, the solid micro-needle system may have up to a 0.5 mg capacity, with 300-1500 solid micro-needles per $cm^2$ about 150-700 lam tall coated with a drug. The micro-needles penetrate the stratum corneum and remain in the skin for short duration (e.g., 20 seconds to 15 minutes). In another example, the hollow micro-needle system has up to a 3 mL capacity to deliver liquid formulations using 15-20 microneedles per cm2 being approximately 950 µm tall. The micro-needles penetrate the skin to allow the liquid formulations to flow from the device into the skin. The hollow micro-needle system may be worn from 1 to 30 minutes depending on the formulation volume and viscocity.

A device for subcutaneous infusion has been described by Dalton et al and is taught for example in U.S. Pat. No. 7,150,726, the contents of which are incorporated herein by reference in their entirety. According to Dalton, multiple needles are incorporated into the device which delivers fluid through the needles into a subcutaneous tissue.

A device and a method for intradermal delivery of vaccines and gene therapeutic agents through microcannula have been described by Mikszta et al. and are taught for example in U.S. Pat. No. 7,473,247, the contents of which are incorporated herein by reference in their entirety. According to Mitszta, at least one hollow micro-needle is incorporated into the device which delivers the vaccines to the subject's skin to a depth of between 0.025 mm and 2 mm.

A method of delivering insulin has been described by Pettis et al and is taught for example in U.S. Pat. No. 7,722,595, the contents of which are incorporated herein by reference in their entirety. According to Pettis, two needles are incorporated into a device wherein both needles insert essentially simultaneously into the skin with the first at a depth of less than 2.5 mm to deliver insulin to intradermal compartment and the second at a depth of greater than 2.5 mm and less than 5.0 mm to deliver insulin to subcutaneous compartment.

Cutaneous injection delivery under suction has been described by Kochamba et al. and is taught for example in U.S. Pat. No. 6,896,666, the contents of which are incorporated herein by reference in their entirety. According to Kochamba, multiple needles in relative adjacency with each other are incorporated into a device which injects a fluid below the cutaneous layer.

A device for withdrawing or delivering a substance through the skin has been described by Down et al and is taught for example in U.S. Pat. No. 6,607,513, the contents of which are incorporated herein by reference in their entirety. According to Down, multiple skin penetrating members which are incorporated into the device have lengths of about 100 microns to about 2000 microns and are about 30 to 50 gauge.

A device for delivering a substance to the skin has been described by Palmer et al and is taught for example in U.S. Pat. No. 6,537,242, the contents of which are incorporated herein by reference in their entirety. According to Palmer, an array of micro-needles is incorporated into the device which uses a stretching assembly to enhance the contact of the needles with the skin and provides a more uniform delivery of the substance.

A perfusion device for localized drug delivery has been described by Zamoyski and is taught for example in U.S. Pat. No. 6,468,247, the contents of which are incorporated herein by reference in their entirety. According to Zamoyski, multiple hypodermic needles are incorporated into the device which injects the contents of the hypodermics into a tissue as said hypodermics are being retracted.

A method for enhanced transport of drugs and biological molecules across tissue by improving the interaction between micro-needles and human skin has been described by Prausnitz et al. and is taught for example in U.S. Pat. No. 6,743,211, the contents of which are incorporated herein by reference in their entirety. According to Prausnitz, multiple micro-needles are incorporated into a device which is able to present a more rigid and less deformable surface to which the micro-needles are applied.

A device for intraorgan administration of medicinal agents has been described by Ting et al and is taught for example in U.S. Pat. No. 6,077,251, the contents of which are incorporated herein by reference in their entirety. According to Ting, multiple needles having side openings for enhanced administration are incorporated into a device which by extending and retracting said needles from and into the needle chamber forces a medicinal agent from a reservoir into said needles and injects said medicinal agent into a target organ.

A multiple needle holder and a subcutaneous multiple channel infusion port has been described by Brown and is taught for example in U.S. Pat. No. 4,695,273, the contents of which are incorporated herein by reference in their entirety. According to Brown, multiple needles on the needle holder are inserted through the septum of the infusion port and communicate with isolated chambers in said infusion port.

A dual hypodermic syringe has been described by Horn and is taught for example in U.S. Pat. No. 3,552,394, the contents of which are incorporated herein by reference in their entirety. According to Horn, two needles incorporated into the device are spaced apart less than 68 mm and may be of different styles and lengths, thus enabling injections to be made to different depths.

A syringe with multiple needles and multiple fluid compartments has been described by Hershberg and is taught for example in U.S. Pat. No. 3,572,336, the contents of which are incorporated herein by reference in their entirety. According to Hershberg, multiple needles are incorporated into the syringe which has multiple fluid compartments and is capable of simultaneously administering incompatible drugs which are not able to be mixed for one injection.

A surgical instrument for intradermal injection of fluids has been described by Eliscu et al. and is taught for example in U.S. Pat. No. 2,588,623, the contents of which are incorporated herein by reference in their entirety. According to Eliscu, multiple needles are incorporated into the instrument which injects fluids intradermally with a wider disperse.

An apparatus for simultaneous delivery of a substance to multiple breast milk ducts has been described by Hung and is taught for example in EP 1818017, the contents of which are incorporated herein by reference in their entirety. According to Hung, multiple lumens are incorporated into the device which inserts though the orifices of the ductal networks and delivers a fluid to the ductal networks.

A catheter for introduction of medications to the tissue of a heart or other organs has been described by Tkebuchava and is taught for example in WO2006138109, the contents of which are incorporated herein by reference in their entirety. According to Tkebuchava, two curved needles are incorporated which enter the organ wall in a flattened trajectory.

Devices for delivering medical agents have been described by Mckay et al. and are taught for example in WO2006118804, the content of which are incorporated herein by reference in their entirety. According to Mckay, multiple needles with multiple orifices on each needle are incorporated into the devices to facilitate regional delivery to a tissue, such as the interior disc space of a spinal disc.

A method for directly delivering an immunomodulatory substance into an intradermal space within a mammalian skin has been described by Pettis and is taught for example in WO2004020014, the contents of which are incorporated herein by reference in their entirety. According to Pettis, multiple needles are incorporated into a device which delivers the substance through the needles to a depth between 0.3 mm and 2 mm.

Methods and devices for administration of substances into at least two compartments in skin for systemic absorption and improved pharmacokinetics have been described by Pettis et al. and are taught for example in WO2003094995, the contents of which are incorporated herein by reference in their entirety. According to Pettis, multiple needles having lengths between about 300 μm and about 5 mm are incorporated into a device which delivers to intradermal and subcutaneous tissue compartments simultaneously.

A drug delivery device with needles and a roller has been described by Zimmerman et al. and is taught for example in WO2012006259, the contents of which are incorporated herein by reference in their entirety. According to Zimmerman, multiple hollow needles positioned in a roller are incorporated into the device which delivers the content in a reservoir through the needles as the roller rotates.

Methods and Devices Utilizing Catheters and/or Lumens

Methods and devices using catheters and lumens may be employed to administer the modified nucleic acids, enhanced modified RNA or ribonucleic acids of the present invention on a single, multi- or split dosing schedule. Such methods and devices are described below.

A catheter-based delivery of skeletal myoblasts to the myocardium of damaged hearts has been described by Jacoby et al and is taught for example in US Patent Publication 20060263338, the contents of which are incorporated herein by reference in their entirety. According to Jacoby, multiple needles are incorporated into the device at least part of which is inserted into a blood vessel and delivers the cell composition through the needles into the localized region of the subject's heart.

An apparatus for treating asthma using neurotoxin has been described by Deem et al and is taught for example in US Patent Publication 20060225742, the contents of which are incorporated herein by reference in their entirety. According to Deem, multiple needles are incorporated into the device which delivers neurotoxin through the needles into the bronchial tissue.

A method for administering multiple-component therapies has been described by Nayak and is taught for example in U.S. Pat. No. 7,699,803, the contents of which are incorporated herein by reference in their entirety. According to Nayak, multiple injection cannulas may be incorporated into a device wherein depth slots may be included for controlling the depth at which the therapeutic substance is delivered within the tissue.

A surgical device for ablating a channel and delivering at least one therapeutic agent into a desired region of the tissue has been described by McIntyre et al and is taught for example in U.S. Pat. No. 8,012,096, the contents of which are incorporated herein by reference in their entirety. According to McIntyre, multiple needles are incorporated into the device which dispenses a therapeutic agent into a region of tissue surrounding the channel and is particularly well suited for transmyocardial revascularization operations.

Methods of treating functional disorders of the bladder in mammalian females have been described by Versi et al and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A device and a method for delivering fluid into a flexible biological barrier have been described by Yeshurun et al. and are taught for example in U.S. Pat. No. 7,998,119 (device) and U.S. Pat. No. 8,007,466 (method), the contents of which are incorporated herein by reference in their entirety. According to Yeshurun, the micro-needles on the device penetrate and extend into the flexible biological barrier and fluid is injected through the bore of the hollow micro-needles.

A method for epicardially injecting a substance into an area of tissue of a heart having an epicardial surface and disposed within a torso has been described by Bonner et al and is taught for example in U.S. Pat. No. 7,628,780, the contents of which are incorporated herein by reference in their entirety. According to Bonner, the devices have elongate shafts and distal injection heads for driving needles into tissue and injecting medical agents into the tissue through the needles.

A device for sealing a puncture has been described by Nielsen et al and is taught for example in U.S. Pat. No. 7,972,358, the contents of which are incorporated herein by reference in their entirety. According to Nielsen, multiple needles are incorporated into the device which delivers a closure agent into the tissue surrounding the puncture tract.

A method for myogenesis and angiogenesis has been described by Chiu et al. and is taught for example in U.S. Pat. No. 6,551,338, the contents of which are incorporated herein by reference in their entirety. According to Chiu, 5 to 15 needles having a maximum diameter of at least 1.25 mm and a length effective to provide a puncture depth of 6 to 20 mm are incorporated into a device which inserts into proximity with a myocardium and supplies an exogeneous angiogenic or myogenic factor to said myocardium through the conduits which are in at least some of said needles.

A method for the treatment of prostate tissue has been described by Bolmsj et al. and is taught for example in U.S. Pat. No. 6,524,270, the contents of which are incorporated herein by reference in their entirety. According to Bolmsj, a device comprising a catheter which is inserted through the urethra has at least one hollow tip extendible into the surrounding prostate tissue. An astringent and analgesic medicine is administered through said tip into said prostate tissue.

A method for infusing fluids to an intraosseous site has been described by Findlay et al. and is taught for example in U.S. Pat. No. 6,761,726, the contents of which are incorporated herein by reference in their entirety. According to Findlay, multiple needles are incorporated into a device which is capable of penetrating a hard shell of material covered by a layer of soft material and delivers a fluid at a predetermined distance below said hard shell of material.

A device for injecting medications into a vessel wall has been described by Vigil et al. and is taught for example in U.S. Pat. No. 5,713,863, the contents of which are incorporated herein by reference in their entirety. According to Vigil, multiple injectors are mounted on each of the flexible tubes in the device which introduces a medication fluid through a multi-lumen catheter, into said flexible tubes and out of said injectors for infusion into the vessel wall.

A catheter for delivering therapeutic and/or diagnostic agents to the tissue surrounding a bodily passageway has been described by Faxon et al. and is taught for example in U.S. Pat. No. 5,464,395, the contents of which are incorporated herein by reference in their entirety. According to Faxon, at least one needle cannula is incorporated into the catheter which delivers the desired agents to the tissue through said needles which project outboard of the catheter.

Balloon catheters for delivering therapeutic agents have been described by Orr and are taught for example in WO2010024871, the contents of which are incorporated herein by reference in their entirety. According to Orr, multiple needles are incorporated into the devices which deliver the therapeutic agents to different depths within the tissue.

Methods and Devices Utilizing Electrical Current

Methods and devices utilizing electric current may be employed to deliver the modified nucleic acids, enhanced modified RNA or ribonucleic acids of the present invention according to the single, multi- or split dosing regimens taught herein. Such methods and devices are described below.

An electro collagen induction therapy device has been described by Marquez and is taught for example in US Patent Publication 20090137945, the contents of which are incorporated herein by reference in their entirety. According to Marquez, multiple needles are incorporated into the device which repeatedly pierce the skin and draw in the skin a portion of the substance which is applied to the skin first.

An electrokinetic system has been described by Etheredge et al. and is taught for example in US Patent Publication 20070185432, the contents of which are incorporated herein by reference in their entirety. According to Etheredge, micro-needles are incorporated into a device which drives by an electrical current the medication through the needles into the targeted treatment site.

An iontophoresis device has been described by Matsumura et al. and is taught for example in U.S. Pat. No. 7,437,189, the contents of which are incorporated herein by reference in their entirety. According to Matsumura, multiple needles are incorporated into the device which is capable of delivering ionizable drug into a living body at higher speed or with higher efficiency.

Intradermal delivery of biologically active agents by needle-free injection and electroporation has been described by Hoffmann et al and is taught for example in U.S. Pat. No. 7,171,264, the contents of which are incorporated herein by reference in their entirety. According to Hoffmann, one or more needle-free injectors are incorporated into an electroporation device and the combination of needle-free injection and electroporation is sufficient to introduce the agent into cells in skin, muscle or mucosa.

A method for electropermeabilization-mediated intracellular delivery has been described by Lundkvist et al. and is taught for example in U.S. Pat. No. 6,625,486, the contents of which are incorporated herein by reference in their entirety. According to Lundkvist, a pair of needle electrodes is incorporated into a catheter. Said catheter is positioned into a body lumen followed by extending said needle electrodes to penetrate into the tissue surrounding said lumen. Then the device introduces an agent through at least one of said needle electrodes and applies electric field by said pair of needle electrodes to allow said agent pass through the cell membranes into the cells at the treatment site.

A delivery system for transdermal immunization has been described by Levin et al. and is taught for example in WO2006003659, the contents of which are incorporated herein by reference in their entirety. According to Levin, multiple electrodes are incorporated into the device which applies electrical energy between the electrodes to generate micro channels in the skin to facilitate transdermal delivery.

A method for delivering RF energy into skin has been described by Schomacker and is taught for example in WO2011163264, the contents of which are incorporated herein by reference in their entirety. According to Schomacker, multiple needles are incorporated into a device which applies vacuum to draw skin into contact with a plate so that needles insert into skin through the holes on the plate and deliver RF energy.

DEFINITIONS

At various places in the present specification, substituents of compounds of the present disclosure are disclosed in groups or in ranges. It is specifically intended that the present disclosure include each and every individual sub-combination of the members of such groups and ranges. For example, the term "$C_{1-6}$ alkyl" is specifically intended to individually disclose methyl, ethyl, $C_3$ alkyl, $C_4$ alkyl, $C_5$ alkyl, and $C_6$ alkyl.

About: As used herein, the term "about" means +/−10% of the recited value.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Auxotrophic: As used herein, the term "auxotrophic" refers to mRNA that comprises at least one feature that triggers or induces the degradation or inactivation of the mRNA such that the protein expression is substantially prevented or reduced in a selected tissue or organ.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological affect on that organism, is considered to be biologically active. In particular embodiments, a nucleic acid molecule of the present invention may be considered biologically active if even a portion of the nucleic acid molecule is biologically active or mimics an activity considered biologically relevant.

Chemical terms: The following provides the definition of various chemical terms from "acyl" to "thiol."

The term "acyl," as used herein, represents a hydrogen or an alkyl group (e.g., a haloalkyl group), as defined herein, that is attached to the parent molecular group through a carbonyl group, as defined herein, and is exemplified by formyl (i.e., a carboxyaldehyde group), acetyl, propionyl, butanoyl and the like. Exemplary unsubstituted acyl groups include from 1 to 7, from 1 to 11, or from 1 to 21 carbons. In some embodiments, the alkyl group is further substituted with 1, 2, 3, or 4 substituents as described herein.

The term "acylamino," as used herein, represents an acyl group, as defined herein, attached to the parent molecular group though an amino group, as defined herein (i.e., —N($R^{N1}$)—C(O)—R, where R is H or an optionally substituted $C_{1-6}$, $C_{1-10}$, or $C_{1-20}$ alkyl group and $R^{N1}$ is as defined herein). Exemplary unsubstituted acylamino groups include from 1 to 41 carbons (e.g., from 1 to 7, from 1 to 13, from 1 to 21, from 2 to 7, from 2 to 13, from 2 to 21, or from 2 to 41 carbons). In some embodiments, the alkyl group is further substituted with 1, 2, 3, or 4 substituents as described herein, and/or the amino group is —$NH_2$ or —$NHR^{N1}$, wherein $R^{N1}$ is, independently, OH, $NO_2$, $NH_2$, $NR^{N2}_2$, $SO_2OR^{N2}$, $SO_2R^{N2}$, $SOR^{N2}$, alkyl, or aryl, and each $R^{N2}$ can be H, alkyl, or aryl.

The term "acyloxy," as used herein, represents an acyl group, as defined herein, attached to the parent molecular group though an oxygen atom (i.e., —O—C(O)—R, where R is H or an optionally substituted $C_{1-6}$, $C_{1-10}$, or $C_{1-20}$ alkyl group). Exemplary unsubstituted acyloxy groups include from 1 to 21 carbons (e.g., from 1 to 7 or from 1 to 11 carbons). In some embodiments, the alkyl group is further substituted with 1, 2, 3, or 4 substituents as described herein, and/or the amino group is —$NH_2$ or —$NHR^{N1}$, wherein $R^{N1}$ is, independently, OH, $NO_2$, $NH_2$, $NR^{N2}_2$, $SO_2OR^{N2}$, $SO_2R^{N2}$, $SOR^{N2}$, alkyl, or aryl, and each $R^{N2}$ can be H, alkyl, or aryl.

The term "alkaryl," as used herein, represents an aryl group, as defined herein, attached to the parent molecular group through an alkylene group, as defined herein. Exemplary unsubstituted alkaryl groups are from 7 to 30 carbons (e.g., from 7 to 16 or from 7 to 20 carbons, such as $C_{1-6}$ alk-$C_{6-10}$ aryl, $C_{1-10}$ alk-$C_{6-10}$ aryl, or $C_{1-20}$ alk-$C_{6-10}$ aryl). In some embodiments, the alkylene and the aryl each can be further substituted with 1, 2, 3, or 4 substituent groups as defined herein for the respective groups. Other groups preceded by the prefix "alk-" are defined in the same manner, where "alk" refers to a $C_{1-6}$ alkylene, unless otherwise noted, and the attached chemical structure is as defined herein.

The term "alkcycloalkyl" represents a cycloalkyl group, as defined herein, attached to the parent molecular group through an alkylene group, as defined herein (e.g., an alkylene group of from 1 to 4, from 1 to 6, from 1 to 10, or form 1 to 20 carbons). In some embodiments, the alkylene and the cycloalkyl each can be further substituted with 1, 2, 3, or 4 substituent groups as defined herein for the respective group.

The term "alkenyl," as used herein, represents monovalent straight or branched chain groups of, unless otherwise specified, from 2 to 20 carbons (e.g., from 2 to 6 or from 2 to 10 carbons) containing one or more carbon-carbon double bonds and is exemplified by ethenyl, 1-propenyl, 2-propenyl, 2-methyl-1-propenyl, 1-butenyl, 2-butenyl, and the like. Alkenyls include both cis and trans isomers. Alkenyl groups may be optionally substituted with 1, 2, 3, or 4 substituent groups that are selected, independently, from amino, aryl, cycloalkyl, or heterocyclyl (e.g., heteroaryl), as defined herein, or any of the exemplary alkyl substituent groups described herein.

The term "alkenyloxy" represents a chemical substituent of formula —OR, where R is a $C_{2-20}$ alkenyl group (e.g., $C_{2-6}$ or $C_{2-10}$ alkenyl), unless otherwise specified. Exemplary alkenyloxy groups include ethenyloxy, propenyloxy, and the like. In some embodiments, the alkenyl group can be further substituted with 1, 2, 3, or 4 substituent groups as defined herein (e.g., a hydroxy group).

The term "alkheteroaryl" refers to a heteroaryl group, as defined herein, attached to the parent molecular group through an alkylene group, as defined herein. Exemplary unsubstituted alkheteroaryl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heteroaryl, $C_{1-10}$ alk-$C_{1-12}$ heteroaryl, or $C_{1-20}$ alk-$C_{1-12}$ heteroaryl). In some embodiments, the alkylene and the heteroaryl each can be further substituted with 1, 2, 3, or 4 substituent groups as defined herein for the respective group. Alkheteroaryl groups are a subset of alkheterocyclyl groups.

The term "alkheterocyclyl" represents a heterocyclyl group, as defined herein, attached to the parent molecular group through an alkylene group, as defined herein. Exemplary unsubstituted alkheterocyclyl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heterocyclyl, $C_{1-10}$ alk-$C_{1-12}$ heterocyclyl, or $C_{1-20}$ alk-$C_{1-12}$ heterocyclyl). In some embodiments, the alkylene and the heterocyclyl each can be further substituted with 1, 2, 3, or 4 substituent groups as defined herein for the respective group.

The term "alkoxy" represents a chemical substituent of formula —OR, where R is a $C_{1-20}$ alkyl group (e.g., $C_{1-6}$ or $C_{1-10}$ alkyl), unless otherwise specified. Exemplary alkoxy groups include methoxy, ethoxy, propoxy (e.g., n-propoxy and isopropoxy), t-butoxy, and the like. In some embodiments, the alkyl group can be further substituted with 1, 2, 3, or 4 substituent groups as defined herein (e.g., hydroxy or alkoxy).

The term "alkoxyalkoxy" represents an alkoxy group that is substituted with an alkoxy group. Exemplary unsubstituted alkoxyalkoxy groups include between 2 to 40 carbons (e.g., from 2 to 12 or from 2 to 20 carbons, such as $C_{1-6}$ alkoxy-$C_{1-6}$ alkoxy, $C_{1-10}$ alkoxy-$C_{1-10}$ alkoxy, or $C_{1-20}$ alkoxy-$C_{1-20}$ alkoxy). In some embodiments, the each alkoxy group can be further substituted with 1, 2, 3, or 4 substituent groups as defined herein.

The term "alkoxyalkyl" represents an alkyl group that is substituted with an alkoxy group. Exemplary unsubstituted alkoxyalkyl groups include between 2 to 40 carbons (e.g., from 2 to 12 or from 2 to 20 carbons, such as $C_{1-6}$ alkoxy-$C_{1-6}$ alkyl, $C_{1-10}$ alkoxy-$C_{1-10}$ alkyl, or $C_{1-20}$ alkoxy-$C_{1-20}$ alkyl). In some embodiments, the alkyl and the alkoxy each can be further substituted with 1, 2, 3, or 4 substituent groups as defined herein for the respective group.

The term "alkoxycarbonyl," as used herein, represents an alkoxy, as defined herein, attached to the parent molecular group through a carbonyl atom (e.g., —C(O)—OR, where R is H or an optionally substituted $C_{1-6}$, $C_{1-10}$, or $C_{1-20}$ alkyl group). Exemplary unsubstituted alkoxycarbonyl include from 1 to 21 carbons (e.g., from 1 to 11 or from 1 to 7 carbons). In some embodiments, the alkoxy group is further substituted with 1, 2, 3, or 4 substituents as described herein.

The term "alkoxycarbonylalkoxy," as used herein, represents an alkoxy group, as defined herein, that is substituted with an alkoxycarbonyl group, as defined herein (e.g., —O-alkyl-C(O)—OR, where R is an optionally substituted $C_{1-6}$, $C_{1-10}$, or $C_{1-20}$ alkyl group). Exemplary unsubstituted alkoxycarbonylalkoxy include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkoxy, $C_{1-10}$ alkoxycarbonyl-$C_{1-10}$ alkoxy, or $C_{1-20}$ alkoxycarbonyl-$C_{1-20}$ alkoxy). In some embodiments, each alkoxy group is further independently substituted with 1, 2, 3, or 4 substituents, as described herein (e.g., a hydroxy group).

The term "alkoxycarbonylalkyl," as used herein, represents an alkyl group, as defined herein, that is substituted with an alkoxycarbonyl group, as defined herein (e.g., -alkyl-C(O)—OR, where R is an optionally substituted $C_{1-20}$, $C_{1-10}$, or $C_{1-6}$ alkyl group). Exemplary unsubstituted alkoxycarbonylalkyl include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkyl, $C_{1-10}$ alkoxycarbonyl-$C_{1-10}$ alkyl, or $C_{1-20}$ alkoxycarbonyl-$C_{1-20}$ alkyl). In some embodiments, each alkyl and alkoxy group is further independently substituted with 1, 2, 3, or 4 substituents as described herein (e.g., a hydroxy group).

The term "alkyl," as used herein, is inclusive of both straight chain and branched chain saturated groups from 1 to 20 carbons (e.g., from 1 to 10 or from 1 to 6), unless otherwise specified. Alkyl groups are exemplified by methyl, ethyl, n- and isopropyl, n-, sec-, iso- and tert-butyl, neopentyl, and the like, and may be optionally substituted with one, two, three, or, in the case of alkyl groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —$NH_2$) or a substituted amino (i.e., —N($R^{N1}$)$_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —$CO_2R^{A'}$, where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —$(CH_2)_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) —C(O)N$R^{B'}R^{C'}$, where each of $R^{B'}$ and $R^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —$SO_2R^{D'}$, where $R^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —$SO_2NR^{E'}R^{F'}$, where each of $R^{E'}$ and $R^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —C(O)$R^{G'}$, where $R^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —$(CH_2)_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (19) —$NR^{H'}C(O)R^{I'}$, wherein $R^{H'}$ is selected from the group consisting of (a1) hydrogen and (b1) $C_{1-6}$ alkyl, and $R^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{J'}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein. For example, the alkylene group of a $C_1$-alkaryl can be further substituted with an oxo group to afford the respective aryloyl substituent.

The term "alkylene" and the prefix "alk-," as used herein, represent a saturated divalent hydrocarbon group derived from a straight or branched chain saturated hydrocarbon by the removal of two hydrogen atoms, and is exemplified by methylene, ethylene, isopropylene, and the like. The term "$C_{x-y}$ alkylene" and the prefix "$C_{x-y}$ alk-" represent alkylene groups having between x and y carbons. Exemplary values for x are 1, 2, 3, 4, 5, and 6, and exemplary values for y are 2, 3, 4, 5, 6, 7, 8, 9, 10, 12, 14, 16, 18, or 20 (e.g., $C_{1-6}$, $C_{1-10}$, $C_{2-20}$, $C_{2-6}$, $C_{2-10}$, or $C_{2-20}$ alkylene). In some embodiments, the alkylene can be further substituted with 1, 2, 3, or 4 substituent groups as defined herein for an alkyl group.

The term "alkylsulfinyl," as used herein, represents an alkyl group attached to the parent molecular group through an —S(O)— group. Exemplary unsubstituted alkylsulfinyl groups are from 1 to 6, from 1 to 10, or from 1 to 20 carbons. In some embodiments, the alkyl group can be further substituted with 1, 2, 3, or 4 substituent groups as defined herein.

The term "alkylsulfinylalkyl," as used herein, represents an alkyl group, as defined herein, substituted by an alkylsulfinyl group. Exemplary unsubstituted alkylsulfinylalkyl groups are from 2 to 12, from 2 to 20, or from 2 to 40 carbons. In some embodiments, each alkyl group can be further substituted with 1, 2, 3, or 4 substituent groups as defined herein.

The term "alkynyl," as used herein, represents monovalent straight or branched chain groups from 2 to 20 carbon atoms (e.g., from 2 to 4, from 2 to 6, or from 2 to 10 carbons) containing a carbon-carbon triple bond and is exemplified by ethynyl, 1-propynyl, and the like. Alkynyl groups may be optionally substituted with 1, 2, 3, or 4 substituent groups that are selected, independently, from aryl, cycloalkyl, or heterocyclyl (e.g., heteroaryl), as defined herein, or any of the exemplary alkyl substituent groups described herein.

The term "alkynyloxy" represents a chemical substituent of formula —OR, where R is a $C_{2-20}$ alkynyl group (e.g., $C_{2-6}$ or $C_{2-10}$ alkynyl), unless otherwise specified. Exemplary alkynyloxy groups include ethynyloxy, propynyloxy, and the like. In some embodiments, the alkynyl group can be further substituted with 1, 2, 3, or 4 substituent groups as defined herein (e.g., a hydroxy group).

The term "amidine," as used herein, represents a —C(=NH)NH$_2$ group.

The term "amino," as used herein, represents —N(R$^{N1}$)$_2$, wherein each R$^{N1}$ is, independently, H, OH, NO$_2$, N(R$^{N2}$)$_2$, SO$_2$OR$^{N2}$, SO$_2$R$^{N2}$, SOR$^{N2}$, an N-protecting group, alkyl, alkenyl, alkynyl, alkoxy, aryl, alkaryl, cycloalkyl, alkcycloalkyl, carboxyalkyl, sulfoalkyl, heterocyclyl (e.g., heteroaryl), or alkheterocyclyl (e.g., alkheteroaryl), wherein each of these recited R$^{N1}$ groups can be optionally substituted, as defined herein for each group; or two R$^{N1}$ combine to form a heterocyclyl or an N-protecting group, and wherein each R$^{N2}$ is, independently, H, alkyl, or aryl. The amino groups of the invention can be an unsubstituted amino (i.e., —NH$_2$) or a substituted amino (i.e., —N(R$^{N1}$)$_2$). In a preferred embodiment, amino is —NH$_2$ or —NHR$^{N1}$, wherein R$^{N1}$ is, independently, OH, NO$_2$, NH$_2$, NR$^{N2}$$_2$, SO$_2$OR$^{N2}$, SO$_2$R$^{N2}$, SOR$^{N2}$, alkyl, carboxyalkyl, sulfoalkyl, or aryl, and each R$^{N2}$ can be H, $C_{1-20}$ alkyl (e.g., $C_{1-6}$ alkyl), or $C_{6-10}$ aryl.

The term "amino acid," as described herein, refers to a molecule having a side chain, an amino group, and an acid group (e.g., a carboxy group of —CO$_2$H or a sulfo group of —SO$_3$H), wherein the amino acid is attached to the parent molecular group by the side chain, amino group, or acid group (e.g., the side chain). In some embodiments, the amino acid is attached to the parent molecular group by a carbonyl group, where the side chain or amino group is attached to the carbonyl group. Exemplary side chains include an optionally substituted alkyl, aryl, heterocyclyl, alkaryl, alkheterocyclyl, aminoalkyl, carbamoylalkyl, and carboxyalkyl. Exemplary amino acids include alanine, arginine, asparagine, aspartic acid, cysteine, glutamic acid, glutamine, glycine, histidine, hydroxynorvaline, isoleucine, leucine, lysine, methionine, norvaline, ornithine, phenylalanine, proline, pyrrolysine, selenocysteine, serine, taurine, threonine, tryptophan, tyrosine, and valine. Amino acid groups may be optionally substituted with one, two, three, or, in the case of amino acid groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —NH$_2$) or a substituted amino (i.e., —N(R$^{N1}$)$_2$, where R$^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —CO$_2$R$^{A'}$, where R$^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (15) —C(O)NR$^{H'}$R$^{G'}$, where each of R$^{B'}$ and R$^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —SO$_2$R$^{D'}$, where R$^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —SO$_2$NR$^{E'}$R$^{F'}$, where each of R$^{E'}$ and R$^{F'}$ is, independently, selected from the group consisting of (a) hydrogen, (b) $C_{1-6}$ alkyl, (c) $C_{6-10}$ aryl and (d) $C_{1-6}$ alk-$C_6$-10 aryl; (18) —C(O)R$^{G'}$, where R$^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (19) —NR$^{H'}$C(O)R$^{I'}$, wherein R$^{H'}$ is selected from the group consisting of (a1) hydrogen and (b1) $C_{1-6}$ alkyl, and R$^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{F}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein.

The term "aminoalkoxy," as used herein, represents an alkoxy group, as defined herein, substituted by an amino group, as defined herein. The alkyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aminoalkyl," as used herein, represents an alkyl group, as defined herein, substituted by an amino group, as defined herein. The alkyl and amino each can be further substituted with 1, 2, 3, or 4 substituents as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aryl," as used herein, represents a mono-, bicyclic, or multicyclic carbocyclic ring system having one or two aromatic rings and is exemplified by phenyl, naphthyl, 1,2-dihydronaphthyl, 1,2,3,4-tetrahydronaphthyl, anthracenyl, phenanthrenyl, fluorenyl, indanyl, indenyl, and the like, and may be optionally substituted with 1, 2, 3, 4, or 5 substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —$(CH_2)_qCO_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —$(CH_2)_qCONR^{B'}R^{C'}$, where q is an integer from zero to four and where $R^{B'}$ and $R^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —$(CH_2)_qSO_2R^{D'}$, where q is an integer from zero to four and where $R^{D'}$ is selected from the group consisting of (a) alkyl, (b) $C_{6-10}$ aryl, and (c) alk-$C_{6-10}$ aryl; (20) —$(CH_2)_qSO_2NR^{E'}R^{F'}$, where q is an integer from zero to four and where each of $R^{E'}$ and $R^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) $C_{2-20}$ alkenyl; and (27) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "arylalkoxy," as used herein, represents an alkaryl group, as defined herein, attached to the parent molecular group through an oxygen atom. Exemplary unsubstituted alkoxyalkyl groups include from 7 to 30 carbons (e.g., from 7 to 16 or from 7 to 20 carbons, such as $C_{6-10}$ aryl-$C_{1-6}$ alkoxy, $C_{6-10}$ aryl-$C_{1-10}$ alkoxy, or $C_{6-10}$ aryl-$C_{1-20}$ alkoxy). In some embodiments, the arylalkoxy group can be substituted with 1, 2, 3, or 4 substituents as defined herein The term "aryloxy" represents a chemical substituent of formula —OR', where R' is an aryl group of 6 to 18 carbons, unless otherwise specified. In some embodiments, the aryl group can be substituted with 1, 2, 3, or 4 substituents as defined herein.

The term "aryloyl," as used herein, represents an aryl group, as defined herein, that is attached to the parent molecular group through a carbonyl group. Exemplary unsubstituted aryloyl groups are of 7 to 11 carbons. In some embodiments, the aryl group can be substituted with 1, 2, 3, or 4 substituents as defined herein.

The term "azido" represents an —$N_3$ group, which can also be represented as —N=N=N.

The term "bicyclic," as used herein, refer to a structure having two rings, which may be aromatic or non-aromatic. Bicyclic structures include spirocyclyl groups, as defined herein, and two rings that share one or more bridges, where such bridges can include one atom or a chain including two, three, or more atoms. Exemplary bicyclic groups include a bicyclic carbocyclyl group, where the first and second rings are carbocyclyl groups, as defined herein; a bicyclic aryl groups, where the first and second rings are aryl groups, as defined herein; bicyclic heterocyclyl groups, where the first ring is a heterocyclyl group and the second ring is a carbocyclyl (e.g., aryl) or heterocyclyl (e.g., heteroaryl) group; and bicyclic heteroaryl groups, where the first ring is a heteroaryl group and the second ring is a carbocyclyl (e.g., aryl) or heterocyclyl (e.g., heteroaryl) group. In some embodiments, the bicyclic group can be substituted with 1, 2, 3, or 4 substituents as defined herein for cycloalkyl, heterocyclyl, and aryl groups.

The terms "carbocyclic" and "carbocyclyl," as used herein, refer to an optionally substituted $C_{3-12}$ monocyclic, bicyclic, or tricyclic structure in which the rings, which may be aromatic or non-aromatic, are formed by carbon atoms. Carbocyclic structures include cycloalkyl, cycloalkenyl, and aryl groups.

The term "carbamoyl," as used herein, represents —C(O)—N($R^{N1}$)$_2$, where the meaning of each $R^{N1}$ is found in the definition of "amino" provided herein.

The term "carbamoylalkyl," as used herein, represents an alkyl group, as defined herein, substituted by a carbamoyl group, as defined herein. The alkyl group can be further substituted with 1, 2, 3, or 4 substituent groups as described herein.

The term "carbamyl," as used herein, refers to a carbamate group having the structure —NR$^{N1}$C(=O)OR or —OC(=O)N(R$^{N1}$)$_2$, where the meaning of each R$^{N1}$ is found in the definition of "amino" provided herein, and R is alkyl, cycloalkyl, alkcycloalkyl, aryl, alkaryl, heterocyclyl (e.g., heteroaryl), or alkheterocyclyl (e.g., alkheteroaryl), as defined herein.

The term "carbonyl," as used herein, represents a C(O) group, which can also be represented as C=O.

The term "carboxyaldehyde" represents an acyl group having the structure —CHO.

The term "carboxy," as used herein, means —CO$_2$H.

The term "carboxyalkoxy," as used herein, represents an alkoxy group, as defined herein, substituted by a carboxy group, as defined herein. The alkoxy group can be further substituted with 1, 2, 3, or 4 substituent groups as described herein for the alkyl group.

The term "carboxyalkyl," as used herein, represents an alkyl group, as defined herein, substituted by a carboxy group, as defined herein. The alkyl group can be further substituted with 1, 2, 3, or 4 substituent groups as described herein.

The term "cyano," as used herein, represents an —CN group.

The term "cycloalkoxy" represents a chemical substituent of formula —OR, where R is a C$_{3-8}$ cycloalkyl group, as defined herein, unless otherwise specified. The cycloalkyl group can be further substituted with 1, 2, 3, or 4 substituent groups as described herein. Exemplary unsubstituted cycloalkoxy groups are from 3 to 8 carbons. In some embodiment, the cycloalkyl group can be further substituted with 1, 2, 3, or 4 substituent groups as described herein.

The term "cycloalkyl," as used herein represents a monovalent saturated or unsaturated non-aromatic cyclic hydrocarbon group from three to eight carbons, unless otherwise specified, and is exemplified by cyclopropyl, cyclobutyl, cyclopentyl, cyclohexyl, cycloheptyl, bicyclo[2.2.1]heptyl, and the like. When the cycloalkyl group includes one carbon-carbon double bond, the cycloalkyl group can be referred to as a "cycloalkenyl" group. Exemplary cycloalkenyl groups include cyclopentenyl, cyclohexenyl, and the like. The cycloalkyl groups of this invention can be optionally substituted with: (1) C$_{1-7}$ acyl (e.g., carboxyaldehyde); (2) C$_{1-20}$ alkyl (e.g., C$_{1-6}$ alkyl, C$_{1-6}$ alkoxy-C$_{1-6}$ alkyl, C$_{1-6}$ alkylsulfinyl-C$_{1-6}$ alkyl, amino-C$_{1-6}$ alkyl, azido-C$_{1-6}$ alkyl, (carboxyaldehyde)-C$_{1-6}$ alkyl, halo-C$_{1-6}$ alkyl (e.g., perfluoroalkyl), hydroxy-C$_{1-6}$ alkyl, nitro-C$_{1-6}$ alkyl, or C$_{1-6}$ thioalkoxy-C$_{1-6}$ alkyl); (3) C$_{1-20}$ alkoxy (e.g., C$_{1-6}$ alkoxy, such as perfluoroalkoxy); (4) C$_{1-6}$ alkylsulfinyl; (5) C$_{6-10}$ aryl; (6) amino; (7) C$_{1-6}$ alk-C$_{6-10}$ aryl; (8) azido; (9) C$_{3-8}$ cycloalkyl; (10) C$_{1-6}$ alk-C$_{3-8}$ cycloalkyl; (11) halo; (12) C$_{1-12}$ heterocyclyl (e.g., C$_{1-12}$ heteroaryl); (13) (C$_{1-12}$ heterocyclyl)oxy; (14) hydroxy; (15) nitro; (16) C$_{1-20}$ thioalkoxy (e.g., C$_{1-6}$ thioalkoxy); (17) —(CH$_2$)$_q$CO$_2$R$^{A'}$, where q is an integer from zero to four, and R$^{A'}$ is selected from the group consisting of (a) C$_{1-6}$ alkyl, (b) C$_{6-10}$ aryl, (c) hydrogen, and (d) C$_{1-6}$ alk-C$_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) C$_{6-10}$ alkyl, (c) C$_{6-10}$ aryl, and (d) C$_{1-6}$ alk-C$_{6-10}$ aryl; (19) —(CH$_2$)$_q$SO$_2$R$^{D'}$, where q is an integer from zero to four and where R$^{D'}$ is selected from the group consisting of (a) C$_{6-10}$ alkyl, (b) C$_{6-10}$ aryl, and (c) C$_{1-6}$ alk-C$_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) C$_{6-10}$ alkyl, (c) C$_{6-10}$ aryl, and (d) C$_{1-6}$ alk-C$_{6-10}$ aryl; (21) thiol; (22) C$_{6-10}$ aryloxy; (23) C$_{3-8}$ cycloalkoxy; (24) C$_{6-10}$ aryl-C$_{1-6}$ alkoxy; (25) C$_{1-6}$ alk-C$_{1-12}$ heterocyclyl (e.g., C$_{1-6}$ alk-C$_1$-12 heteroaryl); (26) oxo; (27) C$_{2-20}$ alkenyl; and (28) C$_{2-20}$ alkynyl. In some embodiments, each of these groups can be further substituted as described herein. For example, the alkylene group of a C$_1$-alkaryl or a C$_1$-alkheterocyclyl can be further substituted with an oxo group to afford the respective aryloyl and (heterocyclyl)oyl substituent group.

The term "diastereomer," as used herein means stereoisomers that are not mirror images of one another and are non-superimposable on one another.

The term "effective amount" of an agent, as used herein, is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

The term "enantiomer," as used herein, means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

The term "halo," as used herein, represents a halogen selected from bromine, chlorine, iodine, or fluorine.

The term "haloalkoxy," as used herein, represents an alkoxy group, as defined herein, substituted by a halogen group (i.e., F, Cl, Br, or I). A haloalkoxy may be substituted with one, two, three, or, in the case of alkyl groups of two carbons or more, four halogens. Haloalkoxy groups include perfluoroalkoxys (e.g., —OCF$_3$), —OCHF$_2$, —OCH$_2$F, —OCCl$_3$, —OCH$_2$CH$_2$Br, —OCH$_2$CH(CH$_2$CH$_2$Br)CH$_3$, and —OCHICH$_3$. In some embodiments, the haloalkoxy group can be further substituted with 1, 2, 3, or 4 substituent groups as described herein for alkyl groups.

The term "haloalkyl," as used herein, represents an alkyl group, as defined herein, substituted by a halogen group (i.e., F, Cl, Br, or I). A haloalkyl may be substituted with one, two, three, or, in the case of alkyl groups of two carbons or more, four halogens. Haloalkyl groups include perfluoroalkyls (e.g., —CF$_3$), —CHF$_2$, —CH$_2$F, —CCl$_3$, —CH$_2$CH$_2$Br, —CH$_2$CH(CH$_2$CH$_2$Br)CH$_3$, and —CHICH$_3$. In some embodiments, the haloalkyl group can be further substituted with 1, 2, 3, or 4 substituent groups as described herein for alkyl groups.

The term "heteroalkylene," as used herein, refers to an alkylene group, as defined herein, in which one or two of the constituent carbon atoms have each been replaced by nitrogen, oxygen, or sulfur. In some embodiments, the heteroalkylene group can be further substituted with 1, 2, 3, or 4 substituent groups as described herein for alkylene groups.

The term "heteroaryl," as used herein, represents that subset of heterocyclyls, as defined herein, which are aromatic: i.e., they contain 4n+2 pi electrons within the mono- or multicyclic ring system. Exemplary unsubstituted heteroaryl groups are of 1 to 12 (e.g., 1 to 11, 1 to 10, 1 to 9, 2 to 12, 2 to 11, 2 to 10, or 2 to 9) carbons. In some embodiment, the heteroaryl is substituted with 1, 2, 3, or 4 substituents groups as defined for a heterocyclyl group.

The term "heterocyclyl," as used herein represents a 5-, 6- or 7-membered ring, unless otherwise specified, containing one, two, three, or four heteroatoms independently selected from the group consisting of nitrogen, oxygen, and sulfur. The 5-membered ring has zero to two double bonds, and the 6- and 7-membered rings have zero to three double bonds. Exemplary unsubstituted heterocyclyl groups are of 1 to 12 (e.g., 1 to 11, 1 to 10, 1 to 9, 2 to 12, 2 to 11, 2 to 10, or 2 to 9) carbons. The term "heterocyclyl" also represents a heterocyclic compound having a bridged multicyclic structure in which one or more carbons and/or heteroatoms bridges two non-adjacent members of a monocyclic ring, e.g., a quinuclidinyl group. The term "heterocyclyl" includes bicyclic, tricyclic, and tetracyclic groups in which any of the above heterocyclic rings is fused to one, two, or three carbocyclic rings, e.g., an aryl ring, a cyclohexane ring, a cyclohexene ring, a cyclopentane ring, a cyclopentene ring, or another monocyclic heterocyclic ring, such as indolyl, quinolyl, isoquinolyl, tetrahydroquinolyl, benzofuryl, benzothienyl and the like. Examples of fused heterocyclyls include tropanes and 1,2,3,5,8,8a-hexahydroindolizine. Heterocyclics include pyrrolyl, pyrrolinyl, pyrrolidinyl, pyrazolyl, pyrazolinyl, pyrazolidinyl, imidazolyl, imidazolinyl, imidazolidinyl, pyridyl, piperidinyl, homopiperidinyl, pyrazinyl, piperazinyl, pyrimidinyl, pyridazinyl, oxazolyl, oxazolidinyl, isoxazolyl, isoxazolidiniyl, morpholinyl, thiomorpholinyl, thiazolyl, thiazolidinyl, isothiazolyl, isothiazolidinyl, indolyl, indazolyl, quinolyl, isoquinolyl, quinoxalinyl, dihydroquinoxalinyl, quinazolinyl, cinnolinyl, phthalazinyl, benzimidazolyl, benzothiazolyl, benzoxazolyl, benzothiadiazolyl, furyl, thienyl, thiazolidinyl, isothiazolyl, triazolyl, tetrazolyl, oxadiazolyl (e.g., 1,2,3-oxadiazolyl), purinyl, thiadiazolyl (e.g., 1,2,3-thiadiazolyl), tetrahydrofuranyl, dihydrofuranyl, tetrahydrothienyl, dihydrothienyl, dihydroindolyl, dihydroquinolyl, tetrahydroquinolyl, tetrahydroisoquinolyl, dihydroisoquinolyl, pyranyl, dihydropyranyl, dithiazolyl, benzofuranyl, isobenzofuranyl, benzothienyl, and the like, including dihydro and tetrahydro forms thereof, where one or more double bonds are reduced and replaced with hydrogens. Still other exemplary heterocyclyls include: 2,3,4,5-tetrahydro-2-oxo-oxazolyl; 2,3-dihydro-2-oxo-1H-imidazolyl; 2,3,4,5-tetrahydro-5-oxo-1H-pyrazolyl (e.g., 2,3,4,5-tetrahydro-2-phenyl-5-oxo-1H-pyrazolyl); 2,3,4,5-tetrahydro-5-oxo-1H-imidazolyl (e.g., 2,3,4,5-tetrahydro-2,4-dioxo-5-methyl-5-phenyl-1H-imidazolyl); 2,3-dihydro-2-thioxo-1,3,4-oxadiazolyl (e.g., 2,3-dihydro-2-thioxo-5-phenyl-1,3,4-oxadiazolyl); 4,5-dihydro-5-oxo-1H-triazolyl (e.g., 4,5-dihydro-3-methyl-4-amino 5-oxo-1H-triazolyl); 1,2,3,4-tetrahydro-2,4-dioxopyridinyl (e.g., 1,2,3,4-tetrahydro-2,4-dioxo-3,3-diethylpyridinyl); 2,6-dioxo-piperidinyl (e.g., 2,6-dioxo-3-ethyl-3-phenylpiperidinyl); 1,6-dihydro-6-oxopyridiminyl; 1,6-dihydro-4-oxopyrimidinyl (e.g., 2-(methylthio)-1,6-dihydro-4-oxo-5-methylpyrimidin-1-yl); 1,2,3,4-tetrahydro-2,4-dioxopyrimidinyl (e.g., 1,2,3,4-tetrahydro-2,4-dioxo-3-ethylpyrimidinyl); 1,6-dihydro-6-oxo-pyridazinyl (e.g., 1,6-dihydro-6-oxo-3-ethylpyridazinyl); 1,6-dihydro-6-oxo-1,2,4-triazinyl (e.g., 1,6-dihydro-5-isopropyl-6-oxo-1,2,4-triazinyl); 2,3-dihydro-2-oxo-1H-indolyl (e.g., 3,3-dimethyl-2,3-dihydro-2-oxo-1H-indolyl and 2,3-dihydro-2-oxo-3,3'-spiropropane-1H-indol-1-yl); 1,3-dihydro-1-oxo-2H-iso-indolyl; 1,3-dihydro-1,3-dioxo-2H-iso-indolyl; 1H-benzopyrazolyl (e.g., 1-(ethoxycarbonyl)-1H-benzopyrazolyl); 2,3-dihydro-2-oxo-1H-benzimidazolyl (e.g., 3-ethyl-2,3-dihydro-2-oxo-1H-benzimidazolyl); 2,3-dihydro-2-oxo-benzoxazolyl (e.g., 5-chloro-2,3-dihydro-2-oxo-benzoxazolyl); 2,3-dihydro-2-oxo-benzoxazolyl; 2-oxo-2H-benzopyranyl; 1,4-benzodioxanyl; 1,3-benzodioxanyl; 2,3-dihydro-3-oxo, 4H-1,3-benzothiazinyl; 3,4-dihydro-4-oxo-3H-quinazolinyl (e.g., 2-methyl-3,4-dihydro-4-oxo-3H-quinazolinyl); 1,2,3,4-tetrahydro-2,4-dioxo-3H-quinazolyl (e.g., 1-ethyl-1,2,3,4-tetrahydro-2,4-dioxo-3H-quinazolyl); 1,2,3,6-tetrahydro-2,6-dioxo-7H-purinyl (e.g., 1,2,3,6-tetrahydro-1,3-dimethyl-2,6-dioxo-7H-purinyl); 1,2,3,6-tetrahydro-2,6-dioxo-1H-purinyl (e.g., 1,2,3,6-tetrahydro-3,7-dimethyl-2,6-dioxo-1H-purinyl); 2-oxobenz[c,d]indolyl; 1,1-dioxo-2H-naphth[1,8-c,d]isothiazolyl; and 1,8-naphthylenedicarboxamido. Additional heterocyclics include 3,3a,4,5,6,6a-hexahydro-pyrrolo[3,4-b]pyrrol-(2H)-yl, and 2,5-diazabicyclo[2.2.1]heptan-2-yl, homopiperazinyl (or diazepanyl), tetrahydropyranyl, dithiazolyl, benzofuranyl, benzothienyl, oxepanyl, thiepanyl, azocanyl, oxecanyl, and thiocanyl. Heterocyclic groups also include groups of the formula

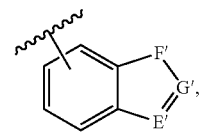

where

E' is selected from the group consisting of —N— and —CH—; F' is selected from the group consisting of —N=CH—, —NH—CH$_2$—, —NH—C(O)—, —NH—, —CH=N—, —CH$_2$—NH—, —C(O)—NH—, —CH=CH—, —CH$_2$—, —CH$_2$CH$_2$—, —CH$_2$O—, —OCH$_2$—, —O—, and —S—; and G' is selected from the group consisting of —CH— and —N—. Any of the heterocyclyl groups mentioned herein may be optionally substituted with one, two, three, four or five substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{2-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —(CH$_2$)$_q$CO$_2$R$^{A'}$, where q is an integer from zero to four, and R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —(CH$_2$)$_q$SO$_2$R$^{D'}$, where q is an integer from zero to four and where R$^{D'}$ is selected from the group consisting of (a) $C_{1-6}$ alkyl, (b) $C_{6-10}$ aryl, and (c) $C_{1-6}$ alk-$C_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) arylalkoxy; (25) $C_{1-6}$ alk-$C_{1-12}$ heterocyclyl (e.g., $C_{1-6}$ alk-$C_{1-12}$ heteroaryl); (26) oxo; (27) ($C_{1-12}$ heterocyclyl) imino; (28) $C_{2-20}$ alkenyl; and (29) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "(heterocyclyl)imino," as used herein, represents a heterocyclyl group, as defined herein, attached to the parent molecular group through an imino group. In some embodiments, the heterocyclyl group can be substituted with 1, 2, 3, or 4 substituent groups as defined herein.

The term "(heterocyclyl)oxy," as used herein, represents a heterocyclyl group, as defined herein, attached to the parent molecular group through an oxygen atom. In some embodiments, the heterocyclyl group can be substituted with 1, 2, 3, or 4 substituent groups as defined herein.

The term "(heterocyclyl)oyl," as used herein, represents a heterocyclyl group, as defined herein, attached to the parent molecular group through a carbonyl group. In some embodiments, the heterocyclyl group can be substituted with 1, 2, 3, or 4 substituent groups as defined herein.

The term "hydrocarbon," as used herein, represents a group consisting only of carbon and hydrogen atoms.

The term "hydroxy," as used herein, represents an —OH group.

The term "hydroxyalkenyl," as used herein, represents an alkenyl group, as defined herein, substituted by one to three hydroxy groups, with the proviso that no more than one hydroxy group may be attached to a single carbon atom of the alkyl group, and is exemplified by dihydroxypropenyl, hydroxyisopentenyl, and the like.

The term "hydroxyalkyl," as used herein, represents an alkyl group, as defined herein, substituted by one to three hydroxy groups, with the proviso that no more than one hydroxy group may be attached to a single carbon atom of the alkyl group, and is exemplified by hydroxymethyl, dihydroxypropyl, and the like.

The term "isomer," as used herein, means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

The term "N-protected amino," as used herein, refers to an amino group, as defined herein, to which is attached one or two N-protecting groups, as defined herein.

The term "N-protecting group," as used herein, represents those groups intended to protect an amino group against undesirable reactions during synthetic procedures. Commonly used N-protecting groups are disclosed in Greene, "Protective Groups in Organic Synthesis," 3$^{rd}$ Edition (John Wiley & Sons, New York, 1999), which is incorporated herein by reference. N-protecting groups include acyl, aryloyl, or carbamyl groups such as formyl, acetyl, propionyl, pivaloyl, t-butylacetyl, 2-chloroacetyl, 2-bromoacetyl, trifluoroacetyl, trichloroacetyl, phthalyl, o-nitrophenoxyacetyl, α-chlorobutyryl, benzoyl, 4-chlorobenzoyl, 4-bromobenzoyl, 4-nitrobenzoyl, and chiral auxiliaries such as protected or unprotected D, L or D, L-amino acids such as alanine, leucine, phenylalanine, and the like; sulfonyl-containing groups such as benzenesulfonyl, p-toluenesulfonyl, and the like; carbamate forming groups such as benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-methoxybenzyloxycarbonyl, 2-nitro-4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxy carbonyl, t-butyloxycarbonyl, diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxy carbonyl, fluorenyl-9-methoxycarbonyl, cyclopentyloxycarbonyl, adamantyloxycarbonyl, cyclohexyloxycarbonyl, phenylthiocarbonyl, and the like, alkaryl groups such as benzyl, triphenylmethyl, benzyloxymethyl, and the like and silyl groups, such as trimethylsilyl, and the like. Preferred N-protecting groups are formyl, acetyl, benzoyl, pivaloyl, t-butylacetyl, alanyl, phenylsulfonyl, benzyl, t-butyloxycarbonyl (Boc), and benzyloxycarbonyl (Cbz).

The term "nitro," as used herein, represents an —NO$_2$ group.

The term "oxo" as used herein, represents =O.

The term "perfluoroalkyl," as used herein, represents an alkyl group, as defined herein, where each hydrogen radical bound to the alkyl group has been replaced by a fluoride radical. Perfluoroalkyl groups are exemplified by trifluoromethyl, pentafluoroethyl, and the like.

The term "perfluoroalkoxy," as used herein, represents an alkoxy group, as defined herein, where each hydrogen radical bound to the alkoxy group has been replaced by a fluoride radical. Perfluoroalkoxy groups are exemplified by trifluoromethoxy, pentafluoroethoxy, and the like.

The term "spirocyclyl," as used herein, represents a $C_{2-7}$ alkylene diradical, both ends of which are bonded to the same carbon atom of the parent group to form a spirocyclic group, and also a $C_{1-6}$ heteroalkylene diradical, both ends of which are bonded to the same atom. The heteroalkylene radical forming the spirocyclyl group can containing one, two, three, or four heteroatoms independently selected from the group consisting of nitrogen, oxygen, and sulfur. In some embodiments, the spirocyclyl group includes one to seven carbons, excluding the carbon atom to which the diradical is attached. The spirocyclyl groups of the invention may be optionally substituted with 1, 2, 3, or 4 substituents provided herein as optional substituents for cycloalkyl and/or heterocyclyl groups.

The term "stereoisomer," as used herein, refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

The term "sulfoalkyl," as used herein, represents an alkyl group, as defined herein, substituted by a sulfo group of —SO$_3$H. In some embodiments, the alkyl group can be further substituted with 1, 2, 3, or 4 substituent groups as described herein.

The term "sulfonyl," as used herein, represents an —S(O)$_2$— group.

The term "thioalkaryl," as used herein, represents a chemical substituent of formula —SR, where R is an alkaryl group. In some embodiments, the alkaryl group can be further substituted with 1, 2, 3, or 4 substituent groups as described herein.

The term "thioalkheterocyclyl," as used herein, represents a chemical substituent of formula —SR, where R is an alkheterocyclyl group. In some embodiments, the alkheterocyclyl group can be further substituted with 1, 2, 3, or 4 substituent groups as described herein.

The term "thioalkoxy," as used herein, represents a chemical substituent of formula —SR, where R is an alkyl group, as defined herein. In some embodiments, the alkyl group can be further substituted with 1, 2, 3, or 4 substituent groups as described herein.

The term "thiol" represents an —SH group.

Compound: As used herein, the term "compound," as used herein, is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond together with the concomitant migration of a proton. Tautomeric forms include prototropic tautomers which are isomeric protonation states having the same empirical formula and total charge. Example prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, for example, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof. Conservation of sequence may apply to the entire length of an oligonucleotide or polypeptide or may apply to a portion, region or feature thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of a modified nucleic acid to targeted cells.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Device: As used herein, the term "device" means a piece of equipment designed to serve a special purpose. The device may comprise many features such as, but not limited to, components, electrical (e.g., wiring and circuits), storage modules and analysis modules.

Disease: As used herein, the term "disease" refers to an abnormal condition affecting the body of an organism often showing specific bodily symptoms.

Disorder: As used herein, the term "disorder," refers to a disruption of or an interference with normal functions or established systems of the body.

Digest: As used herein, the term "digest" means to break apart into smaller pieces or components. When referring to polypeptides or proteins, digestion results in the production of peptides.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a modified nucleic acid and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Heterologous: As used herein, the term "heterologous" in reference to an untranslated region such as a 5'UTR or 3'UTR means a region of nucleic acid, particularly untranslated nucleic acid which is not naturally found with the coding region encoded on the same or instant polynucleotide, primary construct or mmRNA. Homologous UTRs for example would represent those UTRs which are naturally found associated with the coding region of the mRNA, such as the wild type UTR.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% similar. The term "homologous" necessarily refers to a comparison between at least two sequences (polynucleotide or polypeptide sequences).

In accordance with the invention, two polynucleotide sequences are considered to be homologous if the polypeptides they encode are at least about 50% identical, at least about 60% identical, at least about 70% identical, at least about 80% identical, or at least about 90% identical for at least one stretch of at least about 20 amino acids.

In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50% identical, at least about 60% identical, at least about 70% identical, at least about 80% identical, or at least about 90% identical for at least one stretch of at least about 20 amino acids.

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)), BLASTP, BLASTN, and FASTA Atschul, S. F. et al., *J. Molec. Biol.,* 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

Linker: As used herein, a linker refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form modified mRNA multimers (e.g., through linkage of two or more modified nucleic acids) or modified mRNA conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Modified: As used herein "modified" refers to a changed state or structure of a molecule of the invention. Molecules may be modified in many ways including chemically, structurally, and functionally. In one embodiment, the mRNA molecules of the present invention are modified by the introduction of non-natural nucleosides and/or nucleotides.

Naturally occurring: As used herein, "naturally occurring" means existing in nature without artificial aid.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Patient: As used herein, "patient" refers to a subject who may seek or be in need of treatment, requires treatment, is receiving treatment, will receive treatment, or a subject who is under care by a trained professional for a particular disease or condition.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional. Peptide: As used herein, "peptide" is less than or equal to 50 amino acids long, e.g., about 5, 10, 15, 20, 25, 30, 35, 40, 45, or 50 amino acids long.

Peptide: As used herein, "peptide" is less than or equal to 50 amino acids long, e.g., about 5, 10, 15, 20, 25, 30, 35, 40, 45, or 50 amino acids long.

Pharmaceutical composition: The phrase "pharmaceutical composition" refers to a composition that alters the etiology of a disease, disorder and/or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17*th* ed., Mack Publishing Company, Easton, Pa., 1985, p. 1418 and *Journal of Pharmaceutical Science*, 66, 2 (1977), each of which is incorporated herein by reference in its entirety.

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5, 6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestested in ssome way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methyl-pseudouridine (m$^1\psi$), 1-methyl-4-thio-pseudouridine (m$^1$s$^4\psi$), 4-thio-1-methyl-pseudouridine, 3-methyl-pseudouridine (m$^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine (acp$^3\psi$), and 2'-O-methyl-pseudouridine ($\psi$m).

Purified: As used herein, "purify," "purified," "purification" means to make substantially pure or clear from unwanted components, material defilement, admixture or imperfection.

Reducing the effect: As used herein, the phrase "reducing the effect" when referring to symptoms, means reducing, eliminating or alleviating the symptom in the subject. It does not necessarily mean that the symptom will, in fact, be completely eliminated, reduced or alleviated.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Seed: As used herein with respect to micro RNA (miRNA), a miRNA "seed" is a sequence with nucleotide identity at positions 2-8 of the mature miRNA. In one embodiment, a miRNA seed comprises positions 2-7 of the mature miRNA.

Side effect: As used herein, the phrase "side effect" refers to a secondary effect of treatment.

Signal Peptide Sequences: As used herein, the phrase "signal peptide sequences" refers to a sequence which can direct the transport or localization of a protein.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 15 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Symptom: As used herein, the term "symptom" is a signal of a disease, disorder and/or condition. For example, symptoms may be felt or noticed by the subject who has them but may not be easily accessed by looking at a subject's outward appearance or behaviors. Examples of symptoms include, but are not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Terminal region: As used herein, the term "terminal region" refers to a region on the 5' or 3' end of a region of linked nucleosides encoding a polypeptide of interest or coding region.

Terminally optimized: The term "terminally optimized" when referring to nucleic acids means the terminal regions of the nucleic acid are improved over the native terminal regions.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to a disease, disorder, and/or condition, to treat, improve symptoms of, diagnose, prevent, and/or delay the onset of the disease, disorder, and/or condition.

Therapeutically effective outcome: As used herein, "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to a disease, disorder, and/or condition, to treat, improve symptoms of, diagnose, prevent, and/or delay the onset of the disease, disorder, and/or condition.

Total daily dose: As used herein, a "total daily dose" is an amount given or prescribed in 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms or features of a particular disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits the inclusion of additional elements or steps.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

EXAMPLES

Example 1

Modified mRNA Production

Modified mRNAs according to the invention are made using standard laboratory methods and materials.

Figure 3:
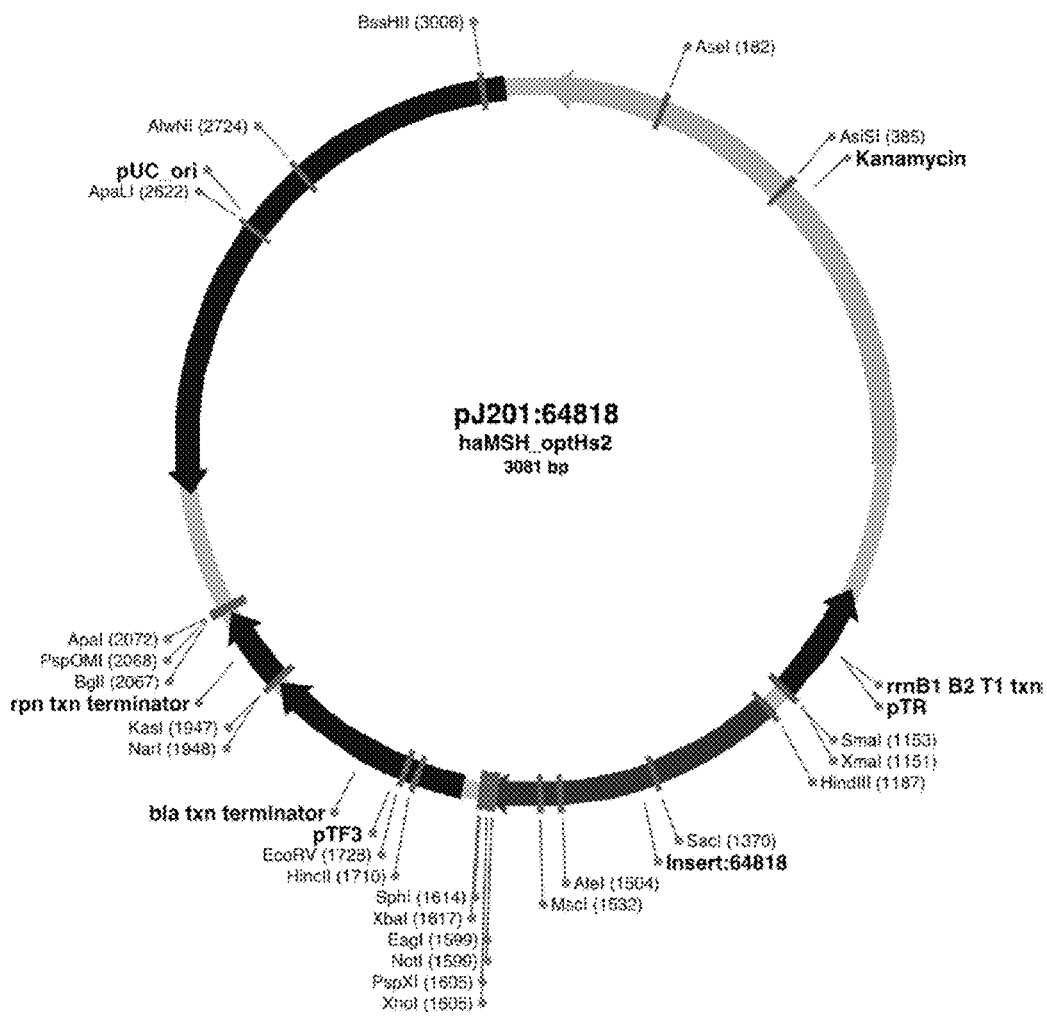
FIG. 3 is a clone map useful in the present invention.

The open reading frame with various upstream or downstream regions (β-globin, tags, etc.) is ordered from DNA2.0 (Menlo Park, Calif.) and typically contains a multiple cloning site with XbaI recognition. Upon receipt of the construct, it is reconstituted and transformed into chemically competent *E. coli*. For the present invention, NEB DH5-alpha Competent *E. coli* are used. A typical clone map is shown in FIG. 3. Transformations are performed according to NEB instructions using 100 ng of plasmid. The protocol is as follows:

1. Thaw a tube of NEB 5-alpha Competent *E. coli* cells on ice for 10 minutes.
2. Add 1-5 µl containing 1 pg-100 ng of plasmid DNA to the cell mixture. Carefully flick the tube 4-5 times to mix cells and DNA. Do not vortex.
3. Place the mixture on ice for 30 minutes. Do not mix.
4. Heat shock at 42° C. for exactly 30 seconds. Do not mix.
5. Place on ice for 5 minutes. Do not mix.
6. Pipette 950 µl of room temperature SOC into the mixture.
7. Place at 37° C. for 60 minutes. Shake vigorously (250 rpm) or rotate.
8. Warm selection plates to 37° C.
9. Mix the cells thoroughly by flicking the tube and inverting.
10. Spread 50-100 µl of each dilution onto a selection plate and incubate overnight at 37° C. Alternatively, incubate at 30° C. for 24-36 hours or 25° C. for 48 hours.

A single colony is then used to inoculate 5 ml of LB growth media using the appropriate antibiotic and then allowed to grow (250 RPM, 37° C.) for 5 hours. This is then used to inoculate a 200 ml culture medium and allowed to grow overnight under the same conditions.

To isolate the plasmid (up to 850 µg), a maxi prep is performed using the Invitrogen PureLink™ HiPure Maxiprep Kit (Carlsbad, Calif.), following the manufacturer's instructions.

In order to generate cDNA for In Vitro Transcription (IVT), the plasmid is first linearized using a restriction enzyme such as XbaI. A typical restriction digest with XbaI will comprise the following: Plasmid 1.0 µg; 10× Buffer 1.0 µl; XbaI 1.5 µl; dH₂0

Up to 10 µl; incubated at 37° C. for 1 hr. If performing at lab scale (<5 µg), the reaction is cleaned up using Invitrogen's PureLink™ PCR Micro Kit (Carlsbad, Calif.) per manufacturer's instructions. Larger scale purifications may need to be done with a product that has a larger load capacity such as Invitrogen's standard PureLink PCR Kit (Carlsbad, Calif.). Following the cleanup, the linearized vector is quantified using the NanoDrop and analyzed to confirm linearization using agarose gel electrophoresis.

As a non-limiting example, G-CSF may represent the polypeptide of interest. Sequences used in the steps outlined in Examples 1-5 are shown in Table 16. It should be noted that the start codon (ATG) has been underlined in each sequence of Table 16.

TABLE 16

G-CSF Sequences

| SEQ ID NO | Description |
|---|---|
| 4255 | cDNA sequence:<br>ATGGCTGGACCTGCCACCCAGAGCCCCATGAAGCTGATGGCCCTG<br>CAGCTGCTGCTGTGGCACAGTGCACTCTGGACAGTGCAGGAAGC<br>CACCCCCCTGGGCCCTGCCAGCTCCCTGCCCCAGAGCTTCCTGCT<br>CAAGTGCTTAGAGCAAGTGAGGAAGATCCAGGGCGATGGCGCAGC<br>GCTCCAGGAGAAGCTGTGTGCCACCTACAAGCTGTGCCACCCCGA<br>GGAGCTGGTGCTGCTCGGACACTCTCTGGGCATCCCCTGGGCTCC<br>CCTGAGCAGCTGCCCCAGCCAGGCCCTGCAGCTGGCAGGCTGCTT<br>GAGCCAACTCCATAGCGGCCTTTTCCTCTACCAGGGGCTCCTGCA<br>GGCCCTGGAAGGGATCTCCCCCGAGTTGGGTCCCACCTTGGACAC<br>ACTGCAGCTGGACGTCGCCGACTTTGCCACCACCATCTGGCAGCA<br>GATGGAAGAACTGGGAATGGCCCCTGCCCTGCAGCCCACCCAGGG<br>TGCCATGCCGGCCTTCGCCTCTGCTTTCCAGCGCCGGGCAGGAGG<br>GGTCCTGGTTGCCTCCCATCTGCAGAGCTTCCTGGAGGTGTCG<br>TACCGCGTTCTACGCCACCTTGCCCAGCCCTGA |
| 4256 | cDNA having T7 polymerase site, AfeI and Xba restriction site:<br>TAATACGACTCACTATA<br>GGGAAATAAGAGAGAAAAGAAGAGTAAGAAGAAATATAAGAGCCA<br>CC<u>ATG</u>GCTGGACCTGCCACCCAGAGCCCCATGAAGCTGATGGCCC<br>TGCAGCTGCTGCTGTGGCACAGTGCACTCTGGACAGTGCAGGAAG<br>CCACCCCCCTGGGCCCTGCCAGCTCCCTGCCCCAGAGCTTCCTGC<br>TCAAGTGCTTAGAGCAAGTGAGGAAGATCCAGGGCGATGGCCAG<br>CGCTCCAGGAGAAGCTGTGTGCCACCTACAAGCTGTGCCACCCCG<br>AGGAGCTGGTGCTGCTCGGACACTCTCTGGGCATCCCCTGGGCTC<br>CCCTGAGCAGCTGCCCCAGCCAGGCCCTGCAGCTGGCAGGCTGCT<br>TGAGCCAACTCCATAGCGGCCTTTTCCTCTACCAGGGGCTCCTGC<br>AGGCCCTGGAAGGGATCTCCCCCGAGTTGGGTCCCACCTTGGACA<br>CACTGCAGCTGGACGTCGCCGACTTTGCCACCACCATCTGGCAGC<br>AGATGGAAGAACTGGGAATGGCCCCTGCCCTGCAGCCCACCCAGG<br>GTGCCATGCCGGCCTTCGCCTCTGCTTTCCAGCGCCGGCAGGAGG<br>GGGTCCTGGTTGCCTCCCATCTGCAGAGCTTCCTGGAGGTGTCGT<br>ACCGCGTTCTACGCCACCTTGCCCAGCCCTGAAGCGCTGCCTTCT<br>GCGGGGCTTGCCTTCTGGCCATGCCCTTCTTCTCTCCCTTGCACC<br>TGTACCTCTTGGTCTTTGAATAAAGCCTGAGTAGGAAGGCG<br>GCCGCTCGAGCATGCATCTAGA |
| 4257 | Optimized sequence; containing T7 polymerase site, AfeI and Xba restriction site<br>TAATACGACTCACTATA<br>GGGAAATAAGAGAGAAAAGAAGAGTAAGAAGAAATATAAGAGCCA<br>CC<u>ATG</u>GCCGGTCCCGCGACCCAAAGCCCCATGAAACTTATGGCCC<br>TGCAGTTGCTGCTTTGGCACTCGGCCCTCTGGACAGTCCAAGAAG<br>CGATCCTCTCGGACCTGCCTCATCGTTGCCGCAGTCATTCCTTT<br>TGAAGTGTCTGGAGCAGGTGCGAAAGATTCAGGGCGATGGAGCCG<br>CACTCCAAGAGAAGCTCTGCGCGACATACAAACTTTGCCATCCCG<br>AGGAGCTCGTACTGCTCGGGCACAGCTTGGGGATTCCCTGGGCTC<br>CTCTCTCGTCCTGTCCGTCGCAGGCTTTGCAGTTGGCAGGGTGCC<br>TTTCCCAGCTCCACTCCGGTTTGTTCTTGTATCAGGGACTGCTGC<br>AAGCCCTTGAGGGAATCTCGCCAGAATTGGGCCCGACGCTGGACA<br>CGTTGCAGCTCGACGTGGCGGATTTCGCAACAACCATCTGGCAGC<br>AGATGGAGGAACTGGGGATGGCACCCGCGCTGCAGCCCACGCAGG<br>GGGCAATGCCGGCCTTTGCGTCCGCGTTTCAGCGCAGGGCGGGTG<br>GAGTCCTCGTAGCGAGCCACCTTCAATCATTTTTGGAAGTCTCG<br>TACCGGGTGCTGAGACATCTGCGCAGCCGTGAAGCGCTGCCTTT<br>CTGCGGGGCTTGCCTTCTGGCCATGCCCTTCTTCTCTCCCTTGC<br>ACCTGTACCTCTTGGTCTTTGAATAAAGCCTGAGTAGGAAGGCG<br>GCCGCTCGAGCATGCATCTAGA |
| 4258 | mRNA sequence (transcribed)<br>GGGAAAUAAGAGAGAAAAGAAGAGUAAGAAGAAAUAUAAGAGCC<br>ACC<u>AUG</u>GCCGGUCCCGCGACCCAAAGCCCCAUGAAACUUAUGGC<br>CCUGCAGUUGCUGCUUUGGCACUCGGCCCUCUGGACAGUCCAAG<br>AAGCGACUCCUCUCGGACCUGCCUCAUCGUUGCCGCAGUCAUUC<br>CUUUUGAAGUGUCUGGAGCAGGUGCGAAAGAUUCAGGGCGAUGG<br>AGCCGCACUCCAAGAGAAGCUCUGCGCGACAUACAAACUUUGCC<br>AUCCCGAGGAGCUCGUACUGCUCGGGCACAGCUUGGGGAUUCCC<br>UGGGCUCCUCUCUCGUCCUGUCCGUCGCAGGCUUUGCAGUUGGC<br>AGGGUGCCUUUCCCAGCUCCACUCCGGUUUGUUCUUGUAUCAGG<br>GACUGCUGCAAGCCCUUGAGGGAAUCUCGCCAGAAUUGGGCCCG<br>ACGCUGGACACGUUGCAGCUCGACGUGGCGGAUUUCGCAACAAC<br>CAUCUGGCAGCAGAUGGAGGAACUGGGGAUGGCACCCGCGCUGC<br>AGCCCACGCAGGGGCAAUGCCGGCCUUUGCGUCCGCGUUUCAG |

TABLE 16-continued

G-CSF Sequences

| SEQ ID NO | Description |
|---|---|
| | CGCAGGGCGGGUGGAGUCCUCGUAGCGAGCCACCUUCAAUCAUU UUUGGAAGUCUCGUACCGGGUGCUGAGACAUCUUGCGCAGCCGU GAAGCGCUGCCUUCUGCGGGGCUUGCCUUCUGGCCAUGCCCUUC UUCUCUCCCUUGCACCUGUACCUCUUGGUCUUUGAAUAAAGCCU GAGUAGGAAG |

Example 2

PCR for cDNA Production

PCR procedures for the preparation of cDNA is performed using 2×KAPA HiFi™ HotStart ReadyMix by Kapa Biosystems (Woburn, Mass.). This system includes 2×KAPA ReadyMix 12.5 µl; Forward Primer (10 uM) 0.75 µl; Reverse Primer (10 uM) 0.75 µl; Template cDNA 100 ng; and dH$_2$0 diluted to 25.0 µl. The reaction conditions are at 95° C. for 5 min. and 25 cycles of 98° C. 20 sec, then 58° C. 15 sec, then 72° C. 45 sec, then 72° C. 5 min. then 4° C. to termination.

The reverse primer of the instant invention incorporates a poly-T$_{120}$ for a poly-A$_{120}$ in the mRNA. Other reverse primers with longer or shorter poly(T) tracts can be used to adjust the length of the poly(A) tail in the mRNA.

The reaction is cleaned up using Invitrogen's PureLink™ PCR Micro Kit (Carlsbad, Calif.) per manufacturer's instructions (up to 5 µg). Larger reactions will require a cleanup using a product with a larger capacity. Following the cleanup, the cDNA is quantified using the NanoDrop and analyzed by agarose gel electrophoresis to confirm the cDNA is the expected size. The cDNA is then submitted for sequencing analysis before proceeding to the in vitro transcription reaction.

Example 3

In Vitro Transcription

The in vitro transcription reaction generates mRNA containing modified nucleotides or modified RNA. The input nucleotide triphosphate (NTP) mix is made in-house using natural and un-natural NTPs.

A typical in vitro transcription reaction includes the following:
1. Template cDNA 1.0 µg
2. 10× transcription buffer (400 mM Tris-HCl pH 8.0, 190 mM MgCl$_2$, 50 mM DTT, 10 mM Spermidine) 2.0 µl
3. Custom NTPs (25 mM each) 7.2 µl
4. RNase Inhibitor 20 U
5. T7 RNA polymerase 3000 U
6. dH$_2$0 Up to 20.0 µl. and
7. Incubation at 37° C. for 3 hr-5 hrs.

The crude IVT mix may be stored at 4° C. overnight for cleanup the next day. 1 U of RNase-free DNase is then used to digest the original template. After 15 minutes of incubation at 37° C., the mRNA is purified using Ambion's MEGAclear™ Kit (Austin, Tex.) following the manufacturer's instructions. This kit can purify up to 500 µg of RNA. Following the cleanup, the RNA is quantified using the NanoDrop and analyzed by agarose gel electrophoresis to confirm the RNA is the proper size and that no degradation of the RNA has occurred.

Example 4

Enzymatic Capping of mRNA

Capping of the mRNA is performed as follows where the mixture includes: IVT RNA 60 µg-180 µg and dH$_2$0 up to 72 µl. The mixture is incubated at 65° C. for 5 minutes to denature RNA, then transfer immediately to ice.

The protocol then involves the mixing of 10× Capping Buffer (0.5 M Tris-HCl (pH 8.0), 60 mM KCl, 12.5 mM MgCl2)(10.0 µl); 20 mM GTP (5.0 µl); 20 mM S-Adenosyl Methionine (2.5 µl); RNase Inhibitor (100 U); 2'-O-Methyltransferase (400 U); Vaccinia capping enzyme (Guanylyl transferase) (40 U); dH$_2$0 (Up to 28 µl); and incubation at 37° C. for 30 minutes for 60 µg RNA or up to 2 hours for 180 µg of RNA.

The mRNA is then purified using Ambion's MEGAclear™ Kit (Austin, Tex.) following the manufacturer's instructions. Following the cleanup, the RNA is quantified using the NanoDrop (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 5

PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5 M Tris-HCl (pH 8.0), 2.5 M NaCl, 100 mM MgCl2)(12.0 µl); 20 mM ATP (6.0 µl); Poly-A Polymerase (20 U); dH$_2$0 up to 123.5 µl and incubation at 37° C. for 30 min. If the poly-A tail is already in the transcript, then the tailing reaction may be skipped and proceed directly to cleanup with Ambion's MEGAclear™ kit (up to 500 µg). Poly-A Polymerase is preferably a recombinant enzyme expressed in yeast.

For studies performed and described herein, the poly-A tail is encoded in the IVT template to comprise 160 nucleotides in length. However, it should be understood that the processivity or integrity of the polyA tailing reaction may not always result in exactly 160 nucleotides. Hence polyA tails of approximately 160 nucleotides, e.g., about 150-165, 155, 156, 157, 158, 159, 160, 161, 162, 163, 164 or 165 are within the scope of the invention.

Example 6

Natural 5' Caps and 5' Cap Analogues

5'-capping of modified RNA may be completed concomitantly during the in vitro-transcription reaction using the following chemical RNA cap analogs to generate the 5'-guanosine cap structure according to manufacturer protocols: 3"-O-Me-m7G(5')ppp(5')G; G(5')ppp(5')A; G(5')ppp (5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G (5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs may have a stability of between 12-18 hours or more than 18 hours, e.g., 24, 36, 48, 60, 72 or greater than 72 hours.

Example 7

Chemical Cap vs. Enzymatically-Derived Cap Protein Expression Assay

Synthetic mRNAs encoding human G-CSF containing the ARCA cap analog or the Cap1 structure can be transfected into human primary keratinocytes at equal concentrations. 6, 12, 24 and 36 hours post-transfection the amount of G-CSF secreted into the culture medium can be assayed by ELISA. Synthetic mRNAs that secrete higher levels of G-CSF into the medium would correspond to a synthetic mRNA with a higher translationally-competent Cap structure.

Example 8

Chemical Cap vs. Enzymatically-Derived Cap Purity Analysis

Synthetic mRNAs encoding human G-CSF containing the ARCA cap analog or the Cap1 structure crude synthesis products can be compared for purity using denaturing Agarose-Urea gel electrophoresis or HPLC analysis. Synthetic mRNAs with a single, consolidated band by electrophoresis correspond to the higher purity product compared to a synthetic mRNA with multiple bands or streaking bands. Synthetic mRNAs with a single HPLC peak would also correspond to a higher purity product. The capping reaction with a higher efficiency would provide a more pure mRNA population.

Example 9

Chemical Cap Vs. Enzymatically-Derived Cap Cytokine Analysis

Synthetic mRNAs encoding human G-CSF containing the ARCA cap analog or the Cap1 structure can be transfected into human primary keratinocytes at multiple concentrations. 6, 12, 24 and 36 hours post-transfection the amount of pro-inflammatory cytokines such as TNF-alpha and IFN-beta secreted into the culture medium can be assayed by ELISA. Synthetic mRNAs that secrete higher levels of pro-inflammatory cytokines into the medium would correspond to a synthetic mRNA containing an immune-activating cap structure.

Example 10

Chemical Cap Vs. Enzymatically-Derived Cap Capping Reaction Efficiency

Synthetic mRNAs encoding human G-CSF containing the ARCA cap analog or the Cap1 structure can be analyzed for capping reaction efficiency by LC-MS after capped mRNA nuclease treatment. Nuclease treatment of capped mRNAs would yield a mixture of free nucleotides and the capped 5'-5-triphosphate cap structure detectable by LC-MS. The amount of capped product on the LC-MS spectra can be expressed as a percent of total mRNA from the reaction and would correspond to capping reaction efficiency. The Cap structure with a higher capping reaction efficiency would have a higher amount of capped product by LC-MS.

Example 11

Agarose Gel Electrophoresis of Modified RNA or RT PCR Products

Individual modRNAs (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 12

Nanodrop Modified RNA Quantification and UV Spectral Data

Modified RNAs in TE buffer (1 µl) are used for Nanodrop UV absorbance readings to quantitate the yield of each modified RNA from an in vitro transcription reaction.

Example 13

In Vitro Transcription of Modified RNA Containing Varying Poly-A Tail Lengths Modified mRNAs were made using standard laboratory methods and materials for in vitro transcription with the exception that the nucleotide mix contains modified nucleotides. Modified mRNAs of the present example included 5-methycytosine and pseudouridine. The open reading frame (ORF) of the gene of interest is flanked by a 5' untranslated region (UTR) containing a strong Kozak translational initiation signal and an alpha-globin 3' UTR terminating with an oligo(dT) sequence for templated addition of a polyA tail for modified RNAs not incorporating Adenosine analogs. Adenosine-containing modRNAs are synthesized without an oligo (dT) sequence to allow for post-transcription poly (A) polymerase poly-(A) tailing. Poly-a tail lengths of 0 nts, 80 nts, 120 nts, 160 nts were generated for human G-CSF. G-CSF sequences include the cDNA sequence (SEQ ID NO: 4257), the mRNA sequence (SEQ ID NO: 4258) and the protein sequence (SEQ ID NO: 4259). Detection of G-CSF may be performed by the primer probe sets for cDNA including the forward primer TTG GAC CCT CGT ACA GAA GCT AAT ACG (SEQ ID NO: 4260), a reverse primer for template Poly(A) tailing $T_{(120)}$CT TCC TAC TCA GGC TTT ATT CAA AGA CCA (SEQ ID NO: 4261) and a reverse primer for post-transcriptional Poly(A) polymerase tailing CTT CCT ACT CAG GCT TTA TTC AAA GAC CA (SED ID NO: 4262). Detection may also be performed by G-CSF modified nucleic acid molecule reverse-transcriptase polymerase chain reaction (RT-PCR) forward primer TGG CCG GTC CCG CGA CCC AA (SEQ ID NO: 4263) and reverse primer GCT TCA CGG CTG CGC AAG AT (SEQ ID NO: 4264).

Synthesized reverse primers were designed and ordered from IDT. The reverse primers incorporate a poly-T40, poly-T80, poly-T120, poly-T160 for a poly-A40, poly-A80, poly-A120, and poly-A160 respectively. The Human Embryonic Kidney (HEK) 293 were grown in Eagles' Minimal Essential Medium (EMEM) and 10% Fetal Bovine Serum (FBS) until they reached a confluence of 80-90%. Approximately 80,000 cells were transfected with 100 ng and 500 ng of modified RNA complexed with RNAiMax from Invitrogen (Carlsbad, Calif.) in a 24-well plate. The RNA:RNAiMax complex was formed by first incubating the RNAiMax with EMEM in a 5× volumetric dilution for 10 minutes at room temperature.

Figure 4:
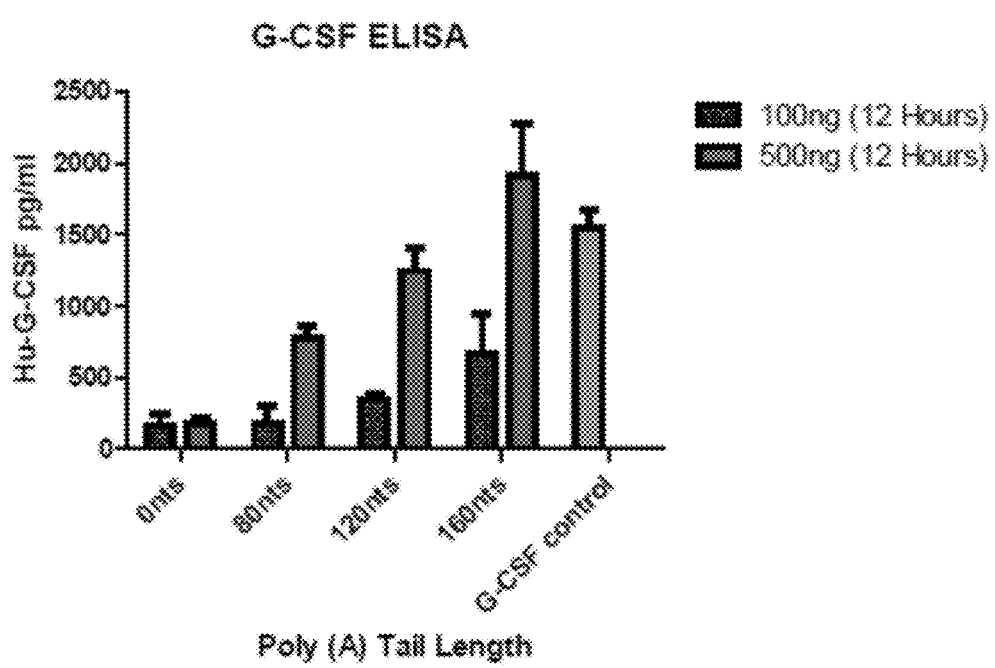
FIG. 4 is a histogram showing the improved protein production from modified mRNAs of the present invention having increasingly longer poly-A tails at two concentrations.

The RNA vial was then mixed with the RNAiMAX vial and incubated for 20-30 at room temperature before being added to the cells in a drop-wise fashion. Recombinant Human G-CSF was added at 2 ng/mL to the control cell culture wells. The concentration of secreted Human G-CSF was measured at 12 hours post-transfection. FIG. 4 shows the histogram for the Enzyme-linked immunosorbent assay (ELISA) for Human G-CSF from HEK293 cells transfected with human G-CSF modified RNA that had varying poly-A tail lengths: 0 nts, 80 nts, 120 nts, 160 nts. We observed increased protein expression with the 160 nts poly-A tail.

From the data it can be determined that longer poly-A tails produce more protein and that this activity is dose dependent.

Example 14

Expression of Modified Nucleic Acid with microRNA Binding Site

Human embryonic kidney epithelial cells (HEK293A) and primary human hepatocytes (Hepatocytes) were seeded at a density of 200,000 per well in 500 ul cell culture medium (InVitro GRO medium from Celsis, Chicago, Ill.). G-CSF mRNA having an alpha-globin 3'UTR (G-CSF alpha) (cDNA sequence is shown in SEQ ID NO: 4265; mRNA sequence is shown in SEQ ID NO: 4266; polyA tail of approximately 160 nucleotides not shown in sequence; 5'Cap, Cap1; fully modified with 5-methylcytidine and pseudouridine) G-CSF mRNA having an alpha-globin 3'UTR and a miR-122 binding site (G-CSF miR-122) (cDNA sequence is shown in SEQ ID NO: 4267; mRNA sequence is shown in SEQ ID NO: 4268; polyA tail of approximately 160 nucleotides not shown in sequence; 5'Cap, Cap1; fully modified with 5-methylcytidine and pseudouridine) or G-CSF mRNA having an alpha-globin 3'UTR with four miR-122 binding sites with the seed deleted (G-CSF no seed) (cDNA sequence is shown in SEQ ID NO: 4269; mRNA sequence is shown in SEQ ID NO: 4270; polyA tail of approximately 160 nucleotides not shown in sequence; 5'Cap, Cap1; fully modified with 5-methylcytidine and pseudouridine) was tested at a concentration of 250 ng per well in 24 well plates. The expression of G-CSF was measured by ELISA and the results are shown in Table 17

TABLE 17

| miR-122 Binding Sites | | |
| --- | --- | --- |
|  | HEK293A Protein Expression (ng/mL) | Hepatocytes Protein Expression (ng/mL) |
| G-CSF alpha | 99.85 | 8.18 |
| G-CSF miR-122 | 87.67 | 0 |
| G-CSF no seed | 200.2 | 8.05 |

Since HEK293 cells do not express miR-122 there was no down-regulation of G-CSF protein from the sequence containing miR-122. Whereas, the human hepatocytes express high levels of miR-122 and there was a drastic down-regulation of G-CSF protein observed when the G-CSF sequence contained the miR-122 target sequence. Consequently, the mRNA functioned as an auxotrophic mRNA.

Example 15

Directed SAR of Pseudouridine and N1-methyl PseudoUridine

With the recent focus on the pyrimidine nucleoside pseudouridine, a series of structure-activity studies were designed to investigate mRNA containing modifications to pseudouridine or N1-methyl-pseudourdine.

The study was designed to explore the effect of chain length, increased lipophilicity, presence of ring structures, and alteration of hydrophobic or hydrophilic interactions when modifications were made at the N1 position, C6 position, the 2-position, the 4-position and on the phosphate backbone. Stability is also investigated.

To this end, modifications involving alkylation, cycloalkylation, alkyl-cycloalkylation, arylation, alkyl-arylation, alkylation moieties with amino groups, alkylation moieties with carboxylic acid groups, and alkylation moieties containing amino acid charged moieties are investigated. The degree of alkylation is generally $C_1$-$C_6$. Examples of the chemistry modifications include those listed in Table 18 and 19.

TABLE 18

| Pseudouridine and N1-methyl Pseudo Uridine SAR | | |
| --- | --- | --- |
| Chemistry Modification | Compound # | Naturally occuring |
| N1-Modifications | | |
| N1-Ethyl-pseudo-UTP | 1 | N |
| N1-Propyl-pseudo-UTP | 2 | N |
| N1-iso-propyl-pseudo-UTP | 3 | N |
| N1-(2,2,2-Trifluoroethyl)-pseudo-UTP | 4 | N |
| N1-Cyclopropyl-pseudo-UTP | 5 | N |
| N1-Cyclopropylmethyl-pseudo-UTP | 6 | N |
| N1-Phenyl-pseudo-UTP | 7 | N |
| N1-Benzyl-pseudo-UTP | 8 | N |
| N1-Aminomethyl-pseudo-UTP | 9 | N |
| P seudo-UTP-N1-2-ethanoic acid | 10 | N |
| N1-(3-Amino-3-carboxypropyl)pseudo-UTP | 11 | N |
| N1-Methyl-3-(3-amino-3-carboxypropyl) pseudo-UTP | 12 | Y |
| C-6 Modifications | | |
| 6-Methyl-pseudo-UTP | 13 | N |
| 6-Trifluoromethyl-pseudo-UTP | 14 | N |
| 6-Methoxy-pseudo-UTP | 15 | N |
| 6-Phenyl-pseudo-UTP | 16 | N |
| 6-Iodo-pseudo-UTP | 17 | N |
| 6-Bromo-pseudo-UTP | 18 | N |
| 6-Chloro-pseudo-UTP | 19 | N |
| 6-Fluoro-pseudo-UTP | 20 | N |
| 2- or 4-position Modifications | | |
| 4-Thio-pseudo-UTP | 21 | N |
| 2-Thio-pseudo-UTP | 22 | N |
| Phosphate backbone Modifications | | |
| Alpha-thio-pseudo-UTP | 23 | N |
| N1-Me-alpha-thio-pseudo-UTP | 24 | N |

TABLE 19

Pseudouridine and N1-methyl Pseudo Uridine SAR

| Chemistry Modification | Compound # | Naturally occuring |
|---|---|---|
| N1-Methyl-pseudo-UTP | 1 | Y |
| N1-Butyl-pseudo-UTP | 2 | N |
| N1-tert-Butyl-pseudo-UTP | 3 | N |
| N1-Pentyl-pseudo-UTP | 4 | N |
| N1-Hexyl-pseudo-UTP | 5 | N |
| N1-Trifluoromethyl-pseudo-UTP | 6 | Y |
| N1-Cyclobutyl-pseudo-UTP | 7 | N |
| N1-Cyclopentyl-pseudo-UTP | 8 | N |
| N1-Cyclohexyl-pseudo-UTP | 9 | N |
| N1-Cycloheptyl-pseudo-UTP | 10 | N |
| N1-Cyclooctyl-pseudo-UTP | 11 | N |
| N1-Cyclobutylmethyl-pseudo-UTP | 12 | N |
| N1-Cyclopentylmethyl-pseudo-UTP | 13 | N |
| N1-Cyclohexylmethyl-pseudo-UTP | 14 | N |
| N1-Cycloheptylmethyl-pseudo-UTP | 15 | N |
| N1-Cyclooctylmethyl-pseudo-UTP | 16 | N |
| N1-p-tolyl-pseudo-UTP | 17 | N |
| N1-(2,4,6-Trimethyl-phenyl)pseudo-UTP | 18 | N |
| N1-(4-Methoxy-phenyl)pseudo-UTP | 19 | N |
| N1-(4-Amino-phenyl)pseudo-UTP | 20 | N |
| N1(4-Nitro-phenyl)pseudo-UTP | 21 | N |
| Pseudo-UTP-N1-p-benzoic acid | 22 | N |
| N1-(4-Methyl-benzyl)pseudo-UTP | 24 | N |
| N1-(2,4,6-Trimethyl-benzyl)pseudo-UTP | 23 | N |
| N1-(4-Methoxy-benzyl)pseudo-UTP | 25 | N |
| N1-(4-Amino-benzyl)pseudo-UTP | 26 | N |
| N1-(4-Nitro-benzyl)pseudo-UTP | 27 | N |
| Pseudo-UTP-N1-methyl-p-benzoic acid | 28 | N |
| N1-(2-Amino-ethyl)pseudo-UTP | 29 | N |
| N1-(3-Amino-propyl)pseudo-UTP | 30 | N |
| N1-(4-Amino-butyl)pseudo-UTP | 31 | N |
| N1-(5-Amino-pentyl)pseudo-UTP | 32 | N |
| N1-(6-Amino-hexyl)pseudo-UTP | 33 | N |
| Pseudo-UTP-N1-3-propionic acid | 34 | N |
| Pseudo-UTP-N1-4-butanoic acid | 35 | N |
| Pseudo-UTP-N1-5-pentanoic acid | 36 | N |
| Pseudo-UTP-N1-6-hexanoic acid | 37 | N |
| Pseudo-UTP-N1-7-heptanoic acid | 38 | N |
| N1-(2-Amino-2-carboxyethyl)pseudo-UTP | 39 | N |
| N1-(4-Amino-4-carboxybutyl)pseudo-UTP | 40 | N |
| N3-Alkyl-pseudo-UTP | 41 | N |
| 6-Ethyl-pseudo-UTP | 42 | N |
| 6-Propyl-pseudo-UTP | 43 | N |
| 6-iso-Propyl-pseudo-UTP | 44 | N |
| 6-Butyl-pseudo-UTP | 45 | N |
| 6-tert-Butyl-pseudo-UTP | 46 | N |
| 6-(2,2,2-Trifluoroethyl)-pseudo-UTP | 47 | N |
| 6-Ethoxy-pseudo-UTP | 48 | N |
| 6-Trifluoromethoxy-pseudo-UTP | 49 | N |
| 6-Phenyl-pseudo-UTP | 50 | N |
| 6-(Substituted-Phenyl)-pseudo-UTP | 51 | N |
| 6-Cyano-pseudo-UTP | 52 | N |
| 6-Azido-pseudo-UTP | 53 | N |
| 6-Amino-pseudo-UTP | 54 | N |
| 6-Ethylcarboxylate-pseudo-UTP | 54b | N |
| 6-Hydroxy-pseudo-UTP | 55 | N |
| 6-Methylamino-pseudo-UTP | 55b | N |
| 6-Dimethylamino-pseudo-UTP | 57 | N |
| 6-Hydroxyamino-pseudo-UTP | 59 | N |
| 6-Formyl-pseudo-UTP | 60 | N |
| 6-(4-Morpholino)-pseudo-UTP | 61 | N |
| 6-(4-Thiomorpholino)-pseudo-UTP | 62 | N |
| N1-Me-4-thio-pseudo-UTP | 63 | N |
| N1-Me-2-thio-pseudo-UTP | 64 | N |
| 1,6-Dimethyl-pseudo-UTP | 65 | N |
| 1-Methyl-6-trifluoromethyl-pseudo-UTP | 66 | N |
| 1-Methyl-6-ethyl-pseudo-UTP | 67 | N |
| 1-Methyl-6-propyl-pseudo-UTP | 68 | N |
| 1-Methyl-6-iso-propyl-pseudo-UTP | 69 | N |
| 1-Methyl-6-butyl-pseudo-UTP | 70 | N |
| 1-Methyl-6-tert-butyl-pseudo-UTP | 71 | N |
| 1-Methyl-6-(2,2,2-Trifluoroethyl)pseudo-UTP | 72 | N |
| 1-Methyl-6-iodo-pseudo-UTP | 73 | N |
| 1-Methyl-6-bromo-pseudo-UTP | 74 | N |
| 1-Methyl-6-chloro-pseudo-UTP | 75 | N |
| 1-Methyl-6-fluoro-pseudo-UTP | 76 | N |
| 1-Methyl-6-methoxy-pseudo-UTP | 77 | N |
| 1-Methyl-6-ethoxy-pseudo-UTP | 78 | N |
| 1-Methyl-6-trifluoromethoxy-pseudo-UTP | 79 | N |
| 1-Methyl-6-phenyl-pseudo-UTP | 80 | N |
| 1-Methyl-6-(substituted phenyl)pseudo-UTP | 81 | N |
| 1-Methyl-6-cyano-pseudo-UTP | 82 | N |
| 1-Methyl-6-azido-pseudo-UTP | 83 | N |
| 1-Methyl-6-amino-pseudo-UTP | 84 | N |
| 1-Methyl-6-ethylcarboxylate-pseudo-UTP | 85 | N |
| 1-Methyl-6-hydroxy-pseudo-UTP | 86 | N |
| 1-Methyl-6-methylamino-pseudo-UTP | 87 | N |
| 1-Methyl-6-dimethylamino-pseudo-UTP | 88 | N |
| 1-Methyl-6-hydroxyamino-pseudo-UTP | 89 | N |
| 1-Methyl-6-formyl-pseudo-UTP | 90 | N |
| 1-Methyl-6-(4-morpholino)-pseudo-UTP | 91 | N |
| 1-Methyl-6-(4-thiomorpholino)-pseudo-UTP | 92 | N |
| 1-Alkyl-6-vinyl-pseudo-UTP | 93 | N |
| 1-Alkyl-6-allyl-pseudo-UTP | 94 | N |
| 1-Alkyl-6-homoallyl-pseudo-UTP | 95 | N |
| 1-Alkyl-6-ethynyl-pseudo-UTP | 96 | N |
| 1-Alkyl-6-(2-propynyl)-pseudo-UTP | 97 | N |
| 1-Alkyl-6-(1-propynyl)-pseudo-UTP | 98 | N |

Example 16

Incorporation of Naturally and Non-Naturally Occurring Nucleosides

Naturally and non-naturally occurring nucleosides are incorporated into mRNA encoding a polypeptide of interest. Examples of these are given in Tables 20 and 21. Certain commercially available nucleoside triphosphates (NTPs) are investigated in the polynucleotides of the invention. A selection of these are given in Table 20. The resultant mRNA are then examined for their ability to produce protein, induce cytokines, and/or produce a therapeutic outcome.

TABLE 20

Naturally and non-naturally occurring nucleosides

| Chemistry Modification | Compound # | Naturally occuring |
|---|---|---|
| N4-Methyl-Cytosine | 1 | Y |
| N4,N4-Dimethyl-2'-OMe-Cytosine | 2 | Y |
| 5-Oxyacetic acid-methyl ester-Uridine | 3 | Y |
| N3-Methyl-pseudo-Uridine | 4 | Y |
| 5-Hydroxymethyl-Cytosine | 5 | Y |
| 5-Trifluoromethyl-Cytosine | 6 | N |
| 5-Trifluoromethyl-Uridine | 7 | N |
| 5-Methyl-amino-methyl-Uridine | 8 | Y |
| 5-Carboxy-methyl-amino-methyl-Uridine | 9 | Y |
| 5-Carboxymethylaminomethyl-2'-OMe-Uridine | 10 | Y |
| 5-Carboxymethylaminomethyl-2-thio-Uridine | 11 | Y |
| 5-Methylaminomethyl-2-thio-Uridine | 12 | Y |
| 5-Methoxy-carbonyl-methyl-Uridine | 13 | Y |
| 5-Methoxy-carbonyl-methyl-2'-OMe-Uridine | 14 | Y |
| 5-Oxyacetic acid-Uridine | 15 | Y |
| 3-(3-Amino-3-carboxypropyl)-Uridine | 16 | Y |
| 5-(carboxyhydroxymethyl)uridine methyl ester | 17 | Y |
| 5-(carboxyhydroxymethyl)uridine | 18 | Y |

TABLE 21

Non-naturally occurring nucleoside triphosphates

| Chemistry Modification | Compound # | Naturally occuring |
|---|---|---|
| N1-Me-GTP | 1 | N |
| 2'-OMe-2-Amino-ATP | 2 | N |
| 2'-OMe-pseudo-UTP | 3 | Y |
| 2'-OMe-6-Me-UTP | 4 | N |
| 2'-Azido-2'-deoxy-ATP | 5 | N |
| 2'-Azido-2'-deoxy-GTP | 6 | N |
| 2'-Azido-2'-deoxy-UTP | 7 | N |
| 2'-Azido-2'-deoxy-CTP | 8 | N |
| 2'-Amino-2'-deoxy-ATP | 9 | N |
| 2'-Amino-2'-deoxy-GTP | 10 | N |
| 2'-Amino-2'-deoxy-UTP | 11 | N |
| 2'-Amino-2'-deoxy-CTP | 12 | N |
| 2-Amino-ATP | 13 | N |
| 8-Aza-ATP | 14 | N |
| Xanthosine-5'-TP | 15 | N |
| 5-Bromo-CTP | 16 | N |
| 2'-F-5-Methyl-2'-deoxy-UTP | 17 | N |
| 5-Aminoallyl-CTP | 18 | N |
| 2-Amino-riboside-TP | 19 | N |

Example 17

Incorporation of Modifications to the Nucleobase and Carbohydrate (Sugar)

Naturally and non-naturally occurring nucleosides are incorporated into mRNA encoding a polypeptide of interest. Commercially available nucleosides and NTPs having modifications to both the nucleobase and carbohydrate (sugar) are examined for their ability to be incorporated into mRNA and to produce protein, induce cytokines, and/or produce a therapeutic outcome. Examples of these nucleosides are given in Tables 22 and 23.

TABLE 22

Combination modifications

| Chemistry Modification | Compound # |
|---|---|
| 5-iodo-2'-fluoro-deoxyuridine | 1 |
| 5-iodo-cytidine | 6 |
| 2'-bromo-deoxyuridine | 7 |
| 8-bromo-adenosine | 8 |
| 8-bromo-guanosine | 9 |
| 2,2'-anhydro-cytidine hydrochloride | 10 |
| 2,2'-anhydro-uridine | 11 |
| 2'-Azido-deoxyuridine | 12 |
| 2-amino-adenosine | 13 |
| N4-Benzoyl-cytidine | 14 |
| N4-Amino-cytidine | 15 |
| 2'-O-Methyl-N4-Acetyl-cytidine | 16 |
| 2'Fluoro-N4-Acetyl-cytidine | 17 |
| 2'Fluor-N4-Bz-cytidine | 18 |
| 2'O-methyl-N4-Bz-cytidine | 19 |
| 2'O-methyl-N6-Bz-deoxyadenosine | 20 |
| 2'Fluoro-N6-Bz-deoxyadenosine | 21 |
| N2-isobutyl-guanosine | 22 |
| 2'Fluro-N2-isobutyl-guanosine | 23 |
| 2'O-methyl-N2-isobutyl-guanosine | 24 |

TABLE 23

Naturally occuring combinations

| Name | Compound # | Naturally occurring |
|---|---|---|
| 5-Methoxycarbonylmethyl-2-thiouridine TP | 1 | Y |
| 5-Methylaminomethyl-2-thiouridine TP | 2 | Y |
| 5-Crbamoylmethyluridine TP | 3 | Y |
| 5-Carbamoylmethyl-2'-O-methyluridine TP | 4 | Y |
| 1-Methyl-3-(3-amino-3-carboxypropyl) pseudouridine TP | 5 | Y |
| 5-Methylaminomethyl-2-selenouridine TP | 6 | Y |
| 5-Carboxymethyluridine TP | 7 | Y |
| 5-Methyldihydrouridine TP | 8 | Y |
| lysidine TP | 9 | Y |
| 5-Taurinomethyluridine TP | 10 | Y |
| 5-Taurinomethyl-2-thiouridine TP | 11 | Y |
| 5-(iso-Pentenylaminomethyl)uridine TP | 12 | Y |
| 5-(iso-Pentenylaminomethyl)-2-thiouridine TP | 13 | Y |
| 5-(iso-Pentenylaminomethyl)-2'-O-methyluridine TP | 14 | Y |
| N4-Acetyl-2'-O-methylcytidine TP | 15 | Y |
| N4,2'-O-Dimethylcytidine TP | 16 | Y |
| 5-Formyl-2'-O-methylcytidine TP | 17 | Y |
| 2'-O-Methylpseudouridine TP | 18 | Y |
| 2-Thio-2'-O-methyluridine TP | 19 | Y |
| 3,2'-O-Dimethyluridine TP | 20 | Y |

In the tables "UTP" stands for uridine triphosphate, "GTP" stands for guanosine triphosphate, "ATP" stands for adenosine triphosphate, "CTP" stands for cytosine triphosphate, "TP" stands for triphosphate and "Bz" stands for benzyl.

Example 18

Signal Sequence Exchange Study

Several variants of mmRNAs encoding human Granulocyte colony stimulating factor (G-CSF) (mRNA sequence shown in SEQ ID NO: 4258; polyA tail of approximately 160 nucleotides not shown in sequence; 5' cap, Cap1) were synthesized using modified nucleotides pseudouridine and 5-methylcytidine (pseudo-U/5mC). These variants included the G-CSF constructs encoding either the wild-type N terminal secretory signal peptide sequence (MAGPATQSP-MKLMALQLLLWHSALWTVQEA; SEQ ID NO: 4271), no secretory signal peptide sequence, or secretory signal peptide sequences taken from other mRNAs. These included sequences where the wild type GCSF signal peptide sequence was replaced with the signal peptide sequence of either: human a-1-anti trypsin (AAT) (MMPSSVSWGILL-LAGLCCLVPVSLA; SEQ ID NO: 4272), human Factor IX (FIX) (MQRVNMIMAESPSLITICLLGYLLSAECTV-FLDHENANKILNRPKR; SEQ ID NO: 4273), human Prolactin (Prolac) (MKGSLLLLLVSNLLLCQSVAP; SEQ ID NO: 4274), or human Albumin (Alb) (MKWVTFISLLFLF-SSAYSRGVFRR; SEQ ID NO: 4275).

250 ng of modified mRNA encoding each G-CSF variant was transfected into HEK293A (293A in the table), mouse myoblast (MM in the table) (C2C12, CRL-1772, ATCC) and rat myoblast (RM in the table) (L6 line, CRL-1458, ATCC) cell lines in a 24 well plate using 1 ul of Lipofectamine 2000

(Life Technologies), each well containing 300,000 cells. The supernatants were harvested after 24 hrs and the secreted G-CSF protein was analyzed by ELISA using the Human G-CSF ELISA kit (Life Technologies). The data shown in Table 24 reveal that cells transfected with G-CSF mmRNA encoding the Albumin signal peptide secrete at least 12 fold more G-CSF protein than its wild type counterpart.

TABLE 24

Signal Peptide Exchange

| Signal peptides | 293A (pg/ml) | MM (pg/ml) | RM (pg/ml) |
|---|---|---|---|
| G-CSF Natural | 9650 | 3450 | 6050 |
| α-1-anti trypsin | 9950 | 5000 | 8475 |
| Factor IX | 11675 | 6175 | 11675 |
| Prolactin | 7875 | 1525 | 9800 |
| Albumin | 122050 | 81050 | 173300 |
| No Signal peptide | 0 | 0 | 0 |

Example 19

3' Untranslated Regions

A 3' UTR may be provided a flanking region. Multiple 3' UTRs may be included in the flanking region and may be the same or of different sequences. Any portion of the flanking regions, including none, may be codon optimized and any may independently contain one or more different structural or chemical modifications, before and/or after codon optimization.

Shown in Table 7 is a listing of 3'-untranslated regions of the invention. Variants of 3' UTRs may be utilized wherein one or more nucleotides are added or removed to the termini, including A, T, C or G.

Example 20

Alteration of Polynucleotide Trafficking: NLS and NES

Two nuclear export signals (NES) which may be incorporated into the polynucleotides of the present invention includes those reported by Muller, et al (Traffic, 2009, 10: 514-527) and are associated with signaling via the gene COMMD1. These are NEST, PVAIIELEL (SEQ ID NO 4276) and NES2, VNQILKTLSE (SEQ ID NO 4277).

Nuclear localization signals may also be used. One such sequence is PKKKRKV (SEQ ID NO: 4278).

Cell lines or mice are administered one or more polynucleotides having a NLS or NES encoded therein. Upon administration the polynucleotide is trafficked to an alternate location, e.g., into the nucleus using the NLS. The polypeptide having the NLS would be trafficked to the nucleus where it would deliver either a survival or death signal to the nuclear microenvironment. Polypeptides which may be localized to the nucleus include those with altered binding properties for DNA which will function to alter the expression profile of the cell in a therapeutically beneficial manner for the cell, tissue or organism.

In one experiment, the polynucleotide encodes a COMMD1 mut1/mut 2+NLS (e.g., both NES signals disrupted plus a NLS added) following the methods of Muller et al, (Traffic 2009; 10: 514-527) and van de Sluis et al, (J Clin Invest. 2010; 120 (6):2119-2130). The signal sequence may encode a polypeptide or a scrambled sequence which is not translatable. The signal sequence encoded would interact with HIF1-alpha to alter the transcritome of the cancer cells.

The experiment is repeated under normal and hypoxic conditions.

Once identified the HIF1-alpha dependent polynucleotide is tested in cancer cell lines clonal survival or a marker of apoptosis is measured and compared to control or mock treated cells.

Example 21 miRNA Binding Sites (BS) Useful as Sensor Sequences in Polynucleotides miRNA-binding sites are used in the 3'UTR of mRNA therapeutics to direct cytotoxic or cytoprotective mRNA therapeutics to specific cells (normal and/or cancerous).

A strong apoptotic signal (i.e., AIFsh—Apoptosis Inducing Factor short isoform) is encoded as the polypeptide or "signal" and is encoded along with a series of 3'UTR miR binding sites, such as that for mir-122a, that would make the polynucleotide relatively much more stable in cancerous cells than in normal cells.

Experiments comparing cancer vs. normal heaptic cell lines where the cancer cell lines have a specific miR signature are performed in vitro. SNU449 or HEP3B (human derived HCC cell lines) are used because both have been shown to have "undetectable miR-122a", whereas normal hepatocytes should have very high miR-122a levels. First a cancer cell is selected which is sensitive to AIFsh polynucleotide (i.e., it results in apoptosis).

Three miR-122a binding sites are encoded into the 3'UTR of an mRNA sequence for AIFsh and the study arms include 2 cell lines (normal hepatocyte, SNU449 or HEP3B)×5 treatments (vehicle alone, polynucleotide untranslatabe, polynucleotide AIFsh (no miR BS in 3'UTR), 3'UTR [miR122a BS×3]-polynucleotide untranslatable, 3'UTR [miR122a BS×3]-polynucleotide AIFsh).

The expected result would be significant apoptosis in the face of polynucleotide AIFsh in both normal and cancer (HEP3B or SNU449) cell lines in the absence of any 3'UTR-miR122a BS. However, a significant difference in the relative apoptosis of normal vs. cancer cell lines in the face of 3'UTR [miR122a BS×3]-polynucleotide AIFsh.

Reversibility of the effect is shown with the co-administration of miR122a to the cancer cell line (e.g., through some transduction of the miR122a activity back into the cancer cell line).

In vivo animal studies are then performed using any of the models disclosed herein or a commercially available orthotopic HCC model.

Example 22

Cell Lines for the Study of Polynucleotides

Polynucleotides of the present invention and formulations comprising the polynucleotides of the present invention or described in International application No PCT/US2012/69610, herein incorporated by reference in its entirety, may be investigated in any number of cancer or normal cell lines. Cell lines useful in the present invention include those from ATCC (Manassas, Va.) and are listed in Table 25.

TABLE 25

Cell lines

| ATCC Number | Hybridoma or Cell line Description | Name |
|---|---|---|
| CCL-171 | *Homo sapiens* (human) Source: Organ: lung Disease: normal Cell Type: fibroblast | MRC-5 |
| CCL-185 | *Homo sapiens* (human) Source: Organ: lung Disease: carcinoma | A549 |
| CCL-248 | *Homo sapiens* (human) Source: Organ: colon Disease: colorectal carcinoma Derived from metastatic site: lung | T84 |
| CCL-256 | *Homo sapiens* (human) Source: Organ: lung Disease: adenocarcinoma; non-small cell lung cancer Derived from metastatic site: pleural effusion | NCI-H2126 [H2126] |
| CCL-257 | *Homo sapiens* (human) Source: Organ: lung Disease: carcinoma; classic small cell lung cancer | NCI-H1688 [H1688] |
| CCL-75 | *Homo sapiens* (human) Source: Organ: lung Disease: normal Cell Type: fibroblast | WI-38 |
| CCL-75.1 | *Homo sapiens* (human) Source: Organ: lung Cell Type: fibroblastSV40 transformed | WI-38 VA-13 subline 2RA |
| CCL-95.1 | *Homo sapiens* (human) Source: Organ: lung Cell Type: SV40 transformed | WI-26 VA4 |
| CRL-10741 | *Homo sapiens* (human) Source: Organ: liver Disease: hepatocellular carcinoma | C3A [HepG2/C3A, derivative of Hep G2 (ATCC HB-8065)] |
| CRL-11233 | *Homo sapiens* (human) Source: Organ: liver Tissue: left lobe Cell Type: epithelialimmortalized with SV40 large T antigen | THLE-3 |
| CRL-11351 | *Homo sapiens* (human) Source: Organ: lung Disease: carcinoma; small cell lung cancer; multidrug resistant Cell Type: epithelial | H69AR |
| CRL-1848 | *Homo sapiens* (human) Source: Organ: lung Disease: mucoepidermoid pulmonary carcinoma | NCI-H292 [H292] |
| CRL-1918 | *Homo sapiens* (human) Source: Organ: pancreas Disease: ductal adenocarcinoma; cystic fibrosis Derived from metastatic site: liver metastasis | CFPAC-1 |
| CRL-1973 | *Homo sapiens* (human) Source: Organ: testis Disease: malignant pluripotent embryonal carcinoma Derived from metastatic site: lung | NTERA-2 cl.D1 [NT2/D1] |
| CRL-2049 | *Homo sapiens* (human) Source: Organ: lung Disease: carcinoma; small cell lung cancer | DMS 79 |
| CRL-2062 | *Homo sapiens* (human) Source: Organ: lung Disease: carcinoma; small cell lung cancer | DMS 53 |
| CRL-2064 | *Homo sapiens* (human) Source: Organ: lung Disease: carcinoma; small cell lung cancer Derived from metastatic site: liver | DMS 153 |
| CRL-2066 | *Homo sapiens* (human) Source: Organ: lung Disease: carcinoma; small cell lung cancer | DMS 114 |
| CRL-2081 | *Homo sapiens* (human) Source: Disease: biphasic mesothelioma Derived from metastatic site: lung | MSTO-211H |
| CRL-2170 | *Homo sapiens* (human) Source: Organ: lung Disease: alveolar cell carcinoma | SW 1573 [SW-1573, SW1573] |
| CRL-2177 | *Homo sapiens* (human) Source: Organ: lung Disease: carcinoma; small cell lung cancer | SW 1271 [SW-1271, SW1271] |
| CRL-2195 | *Homo sapiens* (human) Source: Organ: lung Disease: carcinoma; small cell lung cancer Cell Type: large cell, variant; | SHP-77 |
| CRL-2233 | *Homo sapiens* (human) Source: Organ: liver Disease: hepatocellular carcinoma | SNU-398 |
| CRL-2234 | *Homo sapiens* (human) Source: Organ: liver Tumor Stage: grade II-III/IV Disease: hepatocellular carcinoma | SNU-449 |
| CRL-2235 | *Homo sapiens* (human) Source: Organ: liver Tumor Stage: grade III/IV Disease: hepatocellular carcinoma | SNU-182 |
| CRL-2236 | *Homo sapiens* (human) Source: Organ: liver Tumor Stage: grade II-IV/V Disease: hepatocellular carcinoma | SNU-475 |

TABLE 25-continued

Cell lines

| ATCC Number | Hybridoma or Cell line Description | Name |
|---|---|---|
| CRL-2237 | *Homo sapiens* (human) Source: Organ: liver<br>Tumor Stage: grade IV/V<br>Disease: pleomorphic hepatocellular carcinoma | SNU-387 |
| CRL-2238 | *Homo sapiens* (human) Source: Organ: liver<br>Tumor Stage: grade III/IV<br>Disease: pleomorphic hepatocellular carcinoma | SNU-423 |
| CRL-2503 | *Homo sapiens* (human) Source: Organ: lung<br>Tissue: bronchus<br>Disease: normal | NL20 |
| CRL-2504 | *Homo sapiens* (human) Source: Organ: lung<br>Tissue: bronchus<br>Disease: normal | NL20-TA<br>[NL20T-A] |
| CRL-2706 | *Homo sapiens* (human) Source: Organ: liver<br>Tissue: left lobe<br>Cell Type: epithelialSV40 transformed | THLE-2 |
| CRL-2741 | *Homo sapiens* (human) Source: Organ: lung<br>Tissue: bronchus<br>Cell Type: epithelialHPV-16 E6/E7 transformed | HBE135-E6E7 |
| CRL-2868 | *Homo sapiens* (human) Source: Organ: lung<br>Disease: adenocarcinoma<br>Cell Type: epithelial | HCC827 |
| CRL-2871 | *Homo sapiens* (human) Source: Organ: lung<br>Disease: adenocarcinoma<br>Derived from metastatic site: pleural effusion<br>Cell Type: epithelial | HCC4006 |
| CRL-5800 | *Homo sapiens* (human) Source: Organ: lung<br>Disease: adenocarcinoma; non-small cell lung cancer | NCI-H23 [H23] |
| CRL-5803 | *Homo sapiens* (human) Source: Organ: lung<br>Disease: carcinoma; non-small cell lung cancer<br>Derived from metastatic site: lymph node | NCI-H1299 |
| CRL-5804 | *Homo sapiens* (human) Source: Organ: lung<br>Disease: carcinoma; classic small cell lung cancer<br>Derived from metastatic site: pleural effusion | NCI-H187 [H187] |
| CRL-5807 | *Homo sapiens* (human) Source: Organ: lung<br>Tissue: bronchiole; alveolus<br>Disease: bronchioalveolar carcinoma; non-small cell lung cancer | NCI-H358 [H-358, H358] |
| CRL-5808 | *Homo sapiens* (human) Source: Organ: lung<br>Tumor Stage: stage E<br>Disease: carcinoma; classic small cell lung cancer<br>Derived from metastatic site: pleural effusion | NCI-H378 [H378] |
| CRL-5810 | *Homo sapiens* (human) Source: Organ: lung<br>Tumor Stage: stage 2<br>Disease: adenocarcinoma; non-small cell lung cancer | NCI-H522 [H522] |
| CRL-5811 | *Homo sapiens* (human) Source: Organ: lung<br>Tumor Stage: stage E<br>Disease: carcinoma; variant small cell lung cancer<br>Derived from metastatic site: bone marrow | NCI-H526 [H526] |
| CRL-5815 | *Homo sapiens* (human) Source: Organ: lung<br>Tissue: bronchus<br>Disease: carcinoid | NCI-H727 [H727] |
| CRL-5816 | *Homo sapiens* (human) Source: Organ: lung<br>Tumor Stage: stage 2<br>Disease: carcinoma; non-small cell lung cancer | NCI-H810 [H810] |
| CRL-5817 | *Homo sapiens* (human) Source: Organ: lung<br>Tumor Stage: stage E<br>Disease: carcinoma; classic small cell lung cancer<br>Derived from metastatic site: lymph node | NCI-H889 [H889] |
| CRL-5818 | *Homo sapiens* (human) Source: Organ: lung<br>Disease: carcinoma; non-small cell lung cancer<br>Derived from metastatic site: lymph node | NCI-H1155 [H1155] |
| CRL-5819 | *Homo sapiens* (human) Source: Organ: lung<br>Disease: papillary adenocarcinoma<br>Derived from metastatic site: lymph node | NCI-H1404 [H1404] |
| CRL-5822 | *Homo sapiens* (human) Source: Organ: stomach<br>Disease: gastric carcinoma<br>Derived from metastatic site: liver | NCI-N87 [N87] |
| CRL-5823 | *Homo sapiens* (human) Source: Organ: lung<br>Tumor Stage: stage E<br>Disease: carcinoma; variant small cell lung | NCI-H196 [H196] |

TABLE 25-continued

Cell lines

| ATCC Number | Hybridoma or Cell line Description | Name |
|---|---|---|
| CRL-5824 | cancer<br>Derived from metastatic site: pleural effusion<br>*Homo sapiens* (human) Source: Organ: lung<br>Tumor Stage: stage E<br>Disease: carcinoma; small cell lung cancer | NCI-H211 [H211] |
| CRL-5825 | Derived from metastatic site: bone marrow<br>*Homo sapiens* (human) Source: Organ: lung<br>Tumor Stage: stage E<br>Disease: carcinoma; classic small cell lung cancer | NCI-H220 [H220] |
| CRL-5828 | Derived from metastatic site: pleural effusion<br>*Homo sapiens* (human) Source: Organ: lung<br>Tumor Stage: stage E<br>Disease: carcinoma; classic small cell lung cancer | NCI-H250 [H250] |
| CRL-5831 | Derived from metastatic site: brain<br>*Homo sapiens* (human) Source: Organ: lung<br>Tumor Stage: stage L<br>Disease: carcinoma; variant small cell lung cancer | NCI-H524 [H524] |
| CRL-5834 | Derived from metastatic site: lymph node<br>*Homo sapiens* (human) Source: Organ: lung<br>Tumor Stage: stage 3A<br>Disease: adenosquamous carcinoma; non-small cell lung cancer | NCI-H647 [H647] |
| CRL-5835 | Derived from metastatic site: pleural effusion<br>*Homo sapiens* (human) Source: Organ: lung<br>Disease: bronchioalveolar carcinoma; non-small cell lung cancer | NCI-H650 [H650] |
| CRL-5836 | Derived from metastatic site: lymph node<br>*Homo sapiens* (human) Source: Organ: lung<br>Tumor Stage: stage E<br>Disease: carcinoma; classic small cell lung cancer | NCI-H711 [H711] |
| CRL-5837 | Derived from metastatic site: bone marrow<br>*Homo sapiens* (human) Source: Organ: lung<br>Tumor Stage: stage E<br>Disease: carcinoma; classic small cell lung cancer | NCI-H719 [H719] |
| CRL-5840 | Derived from metastatic site: bone marrow<br>*Homo sapiens* (human) Source: Organ: lung<br>Tumor Stage: stage E<br>Disease: carcinoma; classic small cell lung cancer | NCI-H740 [H740] |
| CRL-5841 | Derived from metastatic site: lymph node<br>*Homo sapiens* (human) Source: Organ: lung<br>Tumor Stage: stage E<br>Disease: carcinoma; classic small cell lung cancer | NCI-H748 [H748] |
| CRL-5842 | Derived from metastatic site: lymph node<br>*Homo sapiens* (human) Source: Organ: lung<br>Tumor Stage: stage E<br>Disease: carcinoma; classic small cell lung cancer | NCI-H774 [H774] |
| CRL-5844 | Derived from metastatic site: soft tissue<br>*Homo sapiens* (human) Source: Organ: lung<br>Tumor stage: 3B<br>Disease: adenocarcinoma; non-small cell lung cancer | NCI-H838 [H838] |
| CRL-5845 | Derived from metastatic site: lymph node<br>*Homo sapiens* (human) Source: Organ: lung<br>Tumor Stage: stage L<br>Disease: carcinoma; variant small cell lung cancer | NCI-H841 [H841] |
| CRL-5846 | Derived from metastatic site: lymph node<br>*Homo sapiens* (human) Source: Organ: lung<br>Tumor Stage: stage L<br>Disease: carcinoma; classic small cell lung cancer | NCI-H847 [H847] |
| CRL-5849 | Derived from metastatic site: pleural effusion<br>*Homo sapiens* (human) Source: Organ: lung<br>Tumor Stage: stage L<br>Disease: carcinoma; classic small cell lung cancer<br>Derived from metastatic site: pleural effusion | NCI-H865 [H865] |

TABLE 25-continued

Cell lines

| ATCC Number | Hybridoma or Cell line Description | Name |
|---|---|---|
| CRL-5850 | *Homo sapiens* (human) Source: Organ: lung Tumor Stage: stage 4 Disease: adenocarcinoma; non-small cell lung cancer Derived from metastatic site: lymph node | NCI-H920 [H920] |
| CRL-5853 | *Homo sapiens* (human) Source: Organ: lung Disease: carcinoma; small cell lung cancer Derived from metastatic site: pleural effusion | NCI-H1048 [H1048] |
| CRL-5855 | *Homo sapiens* (human) Source: Organ: lung Tumor Stage: stage E Disease: carcinoma; classic small cell lung cancer Derived from metastatic site: bone marrow | NCI-H1092 [H1092] |
| CRL-5856 | *Homo sapiens* (human) Source: Organ: lung Tumor Stage: stage E Disease: carcinoma; classic small cell lung cancer Derived from metastatic site: lymph node | NCI-H1105 [H1105] |
| CRL-5858 | *Homo sapiens* (human) Source: Organ: lung Tumor Stage: stage L Disease: carcinoma; small cell lung cancer Derived from metastatic site: lymph node | NCI-H1184 [H1184] |
| CRL-5859 | *Homo sapiens* (human) Source: Organ: lung Tumor Stage: stage E Disease: carcinoma; small cell lung cancer Derived from metastatic site: bone marrow | NCI-H1238 [H1238] |
| CRL-5864 | *Homo sapiens* (human) Source: Organ: lung Disease: carcinoma; small cell lung cancer Derived from metastatic site: cervix | NCI-H1341 [H1341] |
| CRL-5867 | *Homo sapiens* (human) Source: Organ: lung Tumor Stage: stage 3A Disease: carcinoma; non-small cell lung cancer Derived from metastatic site: lymph node | NCI-H1385 [H1385] |
| CRL-5869 | *Homo sapiens* (human) Source: Organ: lung Tumor Stage: stage E Disease: carcinoma; classic small cell lung cancer | NCI-H1417 [H1417] |
| CRL-5870 | *Homo sapiens* (human) Source: Organ: lung Disease: adenocarcinoma; non-small cell lung cancer | NCI-H1435 [H1435] |
| CRL-5871 | *Homo sapiens* (human) Source: Organ: lung Tumor Stage: stage E Disease: carcinoma; classic small cell lung cancer Derived from metastatic site: lymph node | NCI-H1436 [H1436] |
| CRL-5872 | *Homo sapiens* (human) Source: Organ: lung Tumor Stage: stage 1 Disease: adenocarcinoma; non-small cell lung cancer Derived from metastatic site: pleural effusion | NCI-H1437 [H1437] |
| CRL-5874 | *Homo sapiens* (human) Source: Organ: lung Tumor Stage: stage E Disease: carcinoma; small cell lung cancer Derived from metastatic site: pleural effusion | NCI-H1522 [H1522] |
| CRL-5875 | *Homo sapiens* (human) Source: Organ: lung Disease: adenocarcinoma; non-small cell lung cancer | NCI-H1563 [H1563] |
| CRL-5876 | *Homo sapiens* (human) Source: Organ: lung Disease: adenocarcinoma; non-small cell lung cancer Derived from metastatic site: lymph node | NCI-H1568 [H1568] |
| CRL-5877 | *Homo sapiens* (human) Source: Organ: lung Tumor Stage: stage 4 Disease: adenocarcinoma Derived from metastatic site: soft tissue | NCI-H1573 [H1573] |
| CRL-5878 | *Homo sapiens* (human) Source: Organ: lung Tumor Stage: stage 4 Disease: non-small cell lung cancer Cell Type: large cell; | NCI-H1581 [H1581] |
| CRL-5879 | *Homo sapiens* (human) Source: Tumor Stage: stage E Disease: carcinoma; small cell lung cancer Derived from metastatic site: bone marrow | NCI-H1618 [H1618] |

TABLE 25-continued

Cell lines

| ATCC Number | Hybridoma or Cell line Description | Name |
|---|---|---|
| CRL-5881 | *Homo sapiens* (human) Source: Organ: lung<br>Tumor Stage: stage 3B<br>Disease: adenocarcinoma; non-small cell lung cancer<br>Derived from metastatic site: lymph node | NCI-H1623<br>[H1623] |
| CRL-5883 | *Homo sapiens* (human) Source: Organ: lung<br>Tumor Stage: stage 3B<br>Disease: adenocarcinoma; bronchoalveolar carcinoma<br>Derived from metastatic site: pleural effusion | NCI-H1650 [H-1650, H1650] |
| CRL-5884 | *Homo sapiens* (human) Source: Organ: lung<br>Disease: adenocarcinoma; non-small cell lung cancer | NCI-H1651<br>[H1651] |
| CRL-5885 | *Homo sapiens* (human) Source: Organ: lung<br>Disease: adenocarcinoma; bronchoalveolar carcinoma<br>Derived from metastatic site: pleural effusion | NCI-H1666 [H-1666, H1666] |
| CRL-5886 | *Homo sapiens* (human) Source: Organ: lung<br>Tumor Stage: stage L<br>Disease: carcinoma; classic small cell lung cancer | NCI-H1672<br>[H1672] |
| CRL-5887 | *Homo sapiens* (human) Source: Organ: lung<br>Tumor Stage: stage 3B<br>Disease: adenocarcinoma; non-small cell lung cancer<br>Derived from metastatic site: lymph node | NCI-H1693<br>[H1693] |
| CRL-5888 | *Homo sapiens* (human) Source: Organ: lung<br>Tumor Stage: stage E<br>Disease: carcinoma; classic small cell lung cancer<br>Derived from metastatic site: ascites | NCI-H1694<br>[H1694] |
| CRL-5889 | *Homo sapiens* (human) Source: Organ: lung<br>Tumor Stage: stage 1<br>Disease: non-small cell lung cancer<br>Cell Type: squamous cell; | NCI-H1703<br>[H1703] |
| CRL-5891 | *Homo sapiens* (human) Source: Organ: lung<br>Disease: adenocarcinoma; non-small cell lung cancer | NCI-H1734 [H-1734, H1734] |
| CRL-5892 | *Homo sapiens* (human) Source: Organ: lung<br>Tumor Stage: stage 4<br>Disease: adenocarcinoma; non-small cell lung cancer<br>Derived from metastatic site: liver | NCI-H1755<br>[H1755] |
| CRL-5892 | *Homo sapiens* (human) Source: Organ: lung<br>Tumor Stage: stage 4<br>Disease: adenocarcinoma; non-small cell lung cancer<br>Derived from metastatic site: liver | NCI-H1755<br>[H1755] |
| CRL-5893 | *Homo sapiens* (human) Source: Organ: lung<br>Tumor Stage: stage 4<br>Disease: carcinoma; non-small cell lung cancer<br>Derived from metastatic site: lymph node<br>Cell Type: neuroendocrine; | NCI-H1770<br>[H1770] |
| CRL-5896 | *Homo sapiens* (human) Source: Organ: lung<br>Disease: adenocarcinoma; non-small cell lung cancer | NCI-H1793<br>[H1793] |
| CRL-5898 | *Homo sapiens* (human) Source: Organ: lung<br>Tumor Stage: stage L<br>Disease: carcinoma; classic small cell lung cancer | NCI-H1836<br>[H1836] |
| CRL-5899 | *Homo sapiens* (human) Source: Organ: lung<br>Disease: adenocarcinoma; non-small cell lung cancer | NCI-H1838<br>[H1838] |
| CRL-5900 | *Homo sapiens* (human) Source: Organ: lung<br>Tumor Stage: stage 4<br>Disease: non-small cell lung cancer<br>Derived from metastatic site: pleural effusion<br>Cell Type: squamous cell; | NCI-H1869<br>[H1869] |
| CRL-5902 | *Homo sapiens* (human) Source: Organ: lung<br>Tumor Stage: stage E<br>Disease: carcinoma; classic small cell lung cancer<br>Derived from metastatic site: lymph node | NCI-H1876<br>[H1876] |

TABLE 25-continued

Cell lines

| ATCC Number | Hybridoma or Cell line Description | Name |
|---|---|---|
| CRL-5903 | *Homo sapiens* (human) Source: Organ: lung<br>Tumor Stage: stage E<br>Disease: carcinoma; small cell lung cancer<br>Derived from metastatic site: bone marrow | NCI-H1882<br>[H1882] |
| CRL-5904 | *Homo sapiens* (human) Source: Organ: lung<br>Tumor Stage: stage 4<br>Disease: poorly differentiated carcinoma; non-small cell lung cancer<br>Derived from metastatic site: brain<br>Cell Type: large cell; | NCI-H1915<br>[H1915] |
| CRL-5906 | *Homo sapiens* (human) Source: Organ: lung<br>Tumor Stage: stage L<br>Disease: carcinoma; classic small cell lung cancer<br>Derived from metastatic site: lymph node | NCI-H1930<br>[H1930] |
| CRL-5907 | *Homo sapiens* (human) Source: Organ: lung<br>Tumor Stage: stage 3B<br>Disease: adenocarcinoma; non-small cell lung cancer<br>Derived from metastatic site: soft tissue | NCI-H1944<br>[H1944] |
| CRL-5908 | *Homo sapiens* (human) Source: Organ: lung<br>Disease: adenocarcinoma; non-small cell lung cancer | NCI-H1975 [H-1975, H1975] |
| CRL-5909 | *Homo sapiens* (human) Source: Organ: lung<br>Tumor Stage: stage 3A<br>Disease: adenocarcinoma; non-small cell lung cancer<br>Derived from metastatic site: lymph node | NCI-H1993<br>[H1993] |
| CRL-5912 | *Homo sapiens* (human) Source: Organ: lung<br>Tumor Stage: stage 3A<br>Disease: adenocarcinoma; non-small cell lung cancer<br>Derived from metastatic site: lymph node | NCI-H2023<br>[H2023] |
| CRL-5913 | *Homo sapiens* (human) Source: Organ: lung<br>Tumor Stage: stage E<br>Disease: carcinoma; small cell lung cancer<br>Derived from metastatic site: lymph node | NCI-H2029<br>[H2029] |
| CRL-5914 | *Homo sapiens* (human) Source: Organ: lung<br>Disease: adenocarcinoma; non-small cell lung cancer<br>Derived from metastatic site: lymph node | NCI-H2030<br>[H2030] |
| CRL-5917 | *Homo sapiens* (human) Source: Organ: lung<br>Tumor Stage: stage 1<br>Disease: mixed; small cell lung cancer; adenocarcinoma; squamous cell carcinoma | NCI-H2066<br>[H2066] |
| CRL-5918 | *Homo sapiens* (human) Source: Organ: lung<br>Tumor Stage: stage 3A<br>Disease: adenocarcinoma; non-small cell lung cancer | NCI-H2073<br>[H2073] |
| CRL-5920 | *Homo sapiens* (human) Source: Organ: lung<br>Tumor Stage: stage E<br>Disease: carcinoma; classic small cell lung cancer<br>Derived from metastatic site: pleural effusion | NCI-H2081<br>[H2081] |
| CRL-5921 | *Homo sapiens* (human) Source: Organ: lung<br>Disease: adenocarcinoma; non-small cell lung cancer | NCI-H2085<br>[H2085] |
| CRL-5922 | *Homo sapiens* (human) Source: Organ: lung<br>Tumor Stage: stage 1<br>Disease: adenocarcinoma; non-small cell lung cancer<br>Derived from metastatic site: lymph node | NCI-H2087<br>[H2087] |
| CRL-5923 | *Homo sapiens* (human) Source: Organ: lung<br>Tissue: neuroendocrine<br>Tumor Stage: stage 4<br>Disease: non-small cell lung cancer<br>Derived from metastatic site: lymph node | NCI-H2106<br>[H2106] |
| CRL-5924 | *Homo sapiens* (human) Source: Organ: lung<br>Disease: non-small cell lung cancer<br>Derived from metastatic site: pleural effusion | NCI-H2110<br>[H2110] |
| CRL-5926 | *Homo sapiens* (human) Source: Organ: lung<br>Disease: non-small cell lung cancer | NCI-H2135<br>[H2135] |
| CRL-5927 | *Homo sapiens* (human) Source: Organ: lung<br>Tumor Stage: stage E<br>Disease: carcinoma; small cell lung cancer<br>Derived from metastatic site: lymph node | NCI-H2141<br>[H2141] |

TABLE 25-continued

Cell lines

| ATCC Number | Hybridoma or Cell line Description | Name |
|---|---|---|
| CRL-5929 | *Homo sapiens* (human) Source: Organ: lung Tumor Stage: stage E Disease: carcinoma; small cell lung cancer Derived from metastatic site: pleural effusion | NCI-H2171 [H2171] |
| CRL-5930 | *Homo sapiens* (human) Source: Organ: lung Disease: non-small cell lung cancer | NCI-H2172 [H2172] |
| CRL-5931 | *Homo sapiens* (human) Source: Organ: lung Tumor Stage: stage E Disease: carcinoma; small cell lung cancer Derived from metastatic site: bone marrow | NCI-H2195 [H2195] |
| CRL-5932 | *Homo sapiens* (human) Source: Organ: lung Tumor Stage: stage E Disease: carcinoma; small cell lung cancer Derived from metastatic site: bone marrow | NCI-H2196 [H2196] |
| CRL-5933 | *Homo sapiens* (human) Source: Organ: lung Tumor Stage: stage E Disease: carcinoma; small cell lung cancer Derived from metastatic site: lymph node | NCI-H2198 [H2198] |
| CRL-5934 | *Homo sapiens* (human) Source: Organ: lung Tumor Stage: stage E Disease: carcinoma; small cell lung cancer | NCI-H2227 [H2227] |
| CRL-5935 | *Homo sapiens* (human) Source: Organ: lung Disease: adenocarcinoma; non-small cell lung cancer | NCI-H2228 [H2228] |
| CRL-5938 | *Homo sapiens* (human) Source: Organ: lung Tumor Stage: stage 1 Disease: mixed; small cell lung cancer; adenocarcinoma; squamous cell carcinoma | NCI-H2286 [H2286] |
| CRL-5939 | *Homo sapiens* (human) Source: Organ: lung Disease: adenocarcinoma; non-small cell lung cancer Derived from metastatic site: lymph node | NCI-H2291 [H2291] |
| CRL-5940 | *Homo sapiens* (human) Source: Organ: lung Tumor Stage: stage L Disease: carcinoma; small cell lung cancer Derived from metastatic site: lymph node | NCI-H2330 [H2330] |
| CRL-5941 | *Homo sapiens* (human) Source: Organ: lung Tumor Stage: stage 3A Disease: adenocarcinoma; non-small cell lung cancer | NCI-H2342 [H2342] |
| CRL-5942 | *Homo sapiens* (human) Source: Organ: lung Tumor Stage: stage 1 Disease: adenocarcinoma; non-small cell lung cancer | NCI-H2347 [H2347] |
| CRL-5944 | *Homo sapiens* (human) Source: Organ: lung Tumor Stage: stage 4 Disease: adenocarcinoma; non-small cell lung cancer Derived from metastatic site: ascites | NCI-H2405 [H2405] |
| CRL-5945 | *Homo sapiens* (human) Source: Organ: lung Disease: non-small cell lung cancer | NCI-H2444 [H2444] |
| CRL-5975 | *Homo sapiens* (human) Source: Organ: lung Disease: carcinoid | UMC-11 |
| CRL-5976 | *Homo sapiens* (human) Source: Organ: lung Tumor Stage: stage E Disease: carcinoma; small cell lung cancer Derived from metastatic site: lymph node | NCI-H64 [H64] |
| CRL-5978 | *Homo sapiens* (human) Source: Organ: lung Tumor Stage: stage E Disease: carcinoma; small cell lung cancer Derived from metastatic site: liver | NCI-H735 [H735] |
| CRL-5978 | *Homo sapiens* (human) Source: Organ: lung Tumor Stage: stage E Disease: carcinoma; small cell lung cancer Derived from metastatic site: liver | NCI-H735 [H735] |
| CRL-5982 | *Homo sapiens* (human) Source: Organ: lung Tumor Stage: stage L Disease: carcinoma; small cell lung cancer | NCI-H1963 [H1963] |
| CRL-5983 | *Homo sapiens* (human) Source: Organ: lung Tumor Stage: stage E Disease: carcinoma; small cell lung cancer Derived from metastatic site: bone marrow | NCI-H2107 [H2107] |
| CRL-5984 | *Homo sapiens* (human) Source: Organ: lung Tumor Stage: stage E Disease: carcinoma; small cell lung cancer Derived from metastatic site: bone marrow | NCI-H2108 [H2108] |

TABLE 25-continued

Cell lines

| ATCC Number | Hybridoma or Cell line Description | Name |
|---|---|---|
| CRL-5985 | *Homo sapiens* (human) Source: Organ: lung<br>Tumor Stage: stage 4<br>Disease: adenocarcinoma; non-small cell lung cancer<br>Derived from metastatic site: pleural effusion | NCI-H2122 [H2122] |
| CRL-7343 | *Homo sapiens* (human) Source: Organ: lung<br>Disease: cancer | Hs 573.T |
| CRL-7344 | *Homo sapiens* (human) Source: Organ: lung | Hs 573.Lu |
| CRL-8024 | *Homo sapiens* (human) Source: Organ: liver<br>Disease: hepatoma<br>Cell Type: Alexander cells; | PLC/PRF/5 |
| CRL-9609 | *Homo sapiens* (human) Source: Organ: lung<br>Tissue: bronchus<br>Disease: normal<br>Cell Type: epithelialvirus transformed | BEAS-2B |
| HB-8065 | *Homo sapiens* (human) Source: Organ: liver<br>Disease: hepatocellular carcinoma | Hep G2 |
| HTB-105 | *Homo sapiens* (human) Source: Organ: testes<br>Disease: embryonal carcinoma, malignant<br>Derived from metastatic site: lung | Tera-1 |
| HTB-106 | *Homo sapiens* (human) Source: Disease: malignant embryonal carcinoma<br>Derived from metastatic site: lung | Tera-2 |
| HTB-119 | *Homo sapiens* (human) Source: Organ: lung<br>Disease: carcinoma; small cell lung cancer | NCI-H69 [H69] |
| HTB-120 | *Homo sapiens* (human) Source: Organ: lung<br>Disease: carcinoma; small cell lung cancer<br>Derived from metastatic site: pleural effusion | NCI-H128 [H128] |
| HTB-168 | *Homo sapiens* (human) Source: Organ: lung<br>Tissue: bronchus<br>Disease: bronchogenic carcinoma | ChaGo-K-1 |
| HTB-171 | *Homo sapiens* (human) Source: Organ: lung<br>Disease: carcinoma; small cell lung cancer<br>Derived from metastatic site: pleural effusion | NCI-H446 [H446] |
| HTB-172 | *Homo sapiens* (human) Source: Organ: lung<br>Disease: carcinoma; small cell lung cancer<br>Derived from metastatic site: bone marrow | NCI-H209 [H209] |
| HTB-173 | *Homo sapiens* (human) Source: Organ: lung<br>Disease: carcinoma; small cell lung cancer<br>Derived from metastatic site: bone marrow | NCI-H146 [H146] |
| HTB-174 | *Homo sapiens* (human) Source: Organ: lung<br>Disease: papillary adenocarcinoma | NCI-H441 [H441] |
| HTB-175 | *Homo sapiens* (human) Source: Organ: lung<br>Disease: carcinoma; small cell lung cancer<br>Derived from metastatic site: pleural effusion | NCI-H82 [H82] |
| HTB-177 | *Homo sapiens* (human) Source: Organ: lung<br>Disease: carcinoma; large cell lung cancer<br>Derived from metastatic site: pleural effusion | NCI-H460 [H460] |
| HTB-178 | *Homo sapiens* (human) Source: Organ: lung<br>Disease: adenosquamous carcinoma | NCI-H596 [H596] |
| HTB-179 | *Homo sapiens* (human) Source: Organ: lung<br>Disease: adenocarcinoma<br>Derived from metastatic site: pleural effusion | NCI-H676B [H676B] |
| HTB-180 | *Homo sapiens* (human) Source: Organ: lung<br>Disease: carcinoma; small cell lung cancer<br>Derived from metastatic site: bone marrow | NCI-H345 [H345] |
| HTB-181 | *Homo sapiens* (human) Source: Organ: lung<br>Disease: papillary adenocarcinoma<br>Derived from metastatic site: lymph node | NCI-H820 [H820] |
| HTB-182 | *Homo sapiens* (human) Source: Organ: lung<br>Disease: squamous cell carcinoma | NCI-H520 [H520] |
| HTB-183 | *Homo sapiens* (human) Source: Organ: lung<br>Disease: carcinoma; large cell lung cancer<br>Derived from metastatic site: lymph node | NCI-H661 [H661] |
| HTB-184 | *Homo sapiens* (human) Source: Organ: lung<br>Disease: carcinoma; small cell lung cancer; extrapulmonary origin<br>Derived from metastatic site: adrenal gland | NCI-H510A [H510A, NCI-H510] |
| HTB-52 | *Homo sapiens* (human) Source: Organ: liver<br>Tissue: ascites<br>Disease: adenocarcinoma | SK-HEP-1 |
| HTB-53 | *Homo sapiens* (human) Source: Organ: lung<br>Disease: carcinoma | A-427 |

TABLE 25-continued

Cell lines

| ATCC Number | Hybridoma or Cell line Description | Name |
|---|---|---|
| HTB-54 | *Homo sapiens* (human) Source: Organ: lung<br>Tumor Stage: grade III<br>Disease: epidermoid carcinoma<br>Derived from metastatic site: pleura | Calu-1 |
| HTB-55 | *Homo sapiens* (human) Source: Organ: lung<br>Disease: adenocarcinoma<br>Derived from metastatic site: pleural effusion | Calu-3 |
| HTB-56 | *Homo sapiens* (human) Source: Organ: unknown, probably lung<br>Disease: anaplastic carcinoma | Calu-6 |
| HTB-57 | *Homo sapiens* (human) Source: Organ: lung<br>Disease: adenocarcinoma | SK-LU-1 |
| HTB-58 | *Homo sapiens* (human) Source: Organ: lung<br>Disease: squamous cell carcinoma<br>Derived from metastatic site: pleural effusion | SK-MES-1 |
| HTB-59 | *Homo sapiens* (human) Source: Organ: lung<br>Tumor Stage: grade IV<br>Disease: squamous cell carcinoma | SW 900 [SW-900, SW900] |
| HTB-64 | *Homo sapiens* (human) Source: Disease: malignant melanoma<br>Derived from metastatic site: lung | Malme-3M |
| HTB-79 | *Homo sapiens* (human) Source: Organ: pancreas<br>Disease: adenocarcinoma<br>Derived from metastatic site: liver | Capan-1 |

Example 23

RNA Binding Proteins

RNA binding proteins may be provided as proteins and/or as nucleic acids encoding such proteins. RNA binding proteins play a multitude of roles in regulating RNA stability and protein translation. In some embodiments, RNA binding proteins are provided in protein and/or nucleic acid form with elements of the present invention. Such RNA binding proteins include, but are not limited to those listed (along with the ENSG number, identifying the corresponding gene as well as one or more ENST number, identifying transcriptional variants of each) in Table 26.

TABLE 26

RNA binding proteins

| Protein No. | RNA binding protein | ENSG | ENST | ENST SEQ ID NO | ENSP | ENSP SEQ ID NO |
|---|---|---|---|---|---|---|
| 1 | AU RNA binding protein/enoyl-CoA hydratase | 148090 | 422391 | 4279 | 402026 | 4632 |
| 2 | AU RNA binding protein/enoyl-CoA hydratase | 148090 | 303617 | 4280 | 307334 | 4633 |
| 3 | AU RNA binding protein/enoyl-CoA hydratase | 148090 | 375731 | 4281 | 364883 | 4634 |
| 4 | cold inducible RNA binding protein | 99622 | 320936 | 4282 | 322887 | 4635 |
| 5 | cold inducible RNA binding protein | 99622 | 444172 | 4283 | 407512 | 4636 |
| 6 | cold inducible RNA binding protein | 99622 | 413636 | 4284 | 412831 | 4637 |
| 7 | cold shock domain containing C2, RNA binding | 172346 | 306149 | 4285 | 302485 | 4638 |
| 8 | heterogeneous nuclear ribonucleoprotein D (AU-rich element RNA binding protein 1, 37 kDa) | 138668 | 543098 | 4286 | 439380 | 4639 |
| 9 | heterogeneous nuclear ribonucleoprotein D (AU-rich element RNA binding protein 1, 37 kDa) | 138668 | 313899 | 4287 | 313199 | 4640 |
| 10 | heterogeneous nuclear ribonucleoprotein D (AU-rich element RNA binding protein 1, 37 kDa) | 138668 | 541060 | 4288 | 437416 | 4641 |
| 11 | heterogeneous nuclear ribonucleoprotein D (AU-rich element RNA binding protein 1, 37 kDa) | 138668 | 503822 | 4289 | 422615 | 4642 |
| 12 | heterogeneous nuclear ribonucleoprotein D (AU-rich | 138668 | 507010 | 4290 | 421952 | 4643 |

TABLE 26-continued

| | RNA binding proteins | | | | | |
|---|---|---|---|---|---|---|
| Protein No. | RNA binding protein | ENSG | ENST | ENST SEQ ID NO | ENSP | ENSP SEQ ID NO |
| | element RNA binding protein 1, 37 kDa) | | | | | |
| 13 | heterogeneous nuclear ribonucleoprotein D (AU-rich element RNA binding protein 1, 37 kDa) | 138668 | 353341 | 4291 | 313327 | 4644 |
| 14 | heterogeneous nuclear ribonucleoprotein D (AU-rich element RNA binding protein 1, 37 kDa) | 138668 | 514671 | 4292 | 426446 | 4645 |
| 15 | heterogeneous nuclear ribonucleoprotein D (AU-rich element RNA binding protein 1, 37 kDa) | 138668 | 352301 | 4293 | 305860 | 4646 |
| 16 | heterogeneous nuclear ribonucleoprotein D (AU-rich element RNA binding protein 1, 37 kDa) | 138668 | 307213 | 4294 | 307544 | 4647 |
| 17 | insulin-like growth factor 2 mRNA binding protein 1 | 159217 | 290341 | 4295 | 290341 | 4648 |
| 18 | insulin-like growth factor 2 mRNA binding protein 2 | 73792 | 382199 | 4296 | 371634 | 4649 |
| 19 | insulin-like growth factor 2 mRNA binding protein 2 | 73792 | 421047 | 4297 | 413787 | 4650 |
| 20 | insulin-like growth factor 2 mRNA binding protein 2 | 73792 | 346192 | 4298 | 320204 | 4651 |
| 21 | insulin-like growth factor 2 mRNA binding protein 3 | 136231 | 258729 | 4299 | 258729 | 4652 |
| 22 | KH domain containing, RNA binding, signal transduction associated 1 | 121774 | 327300 | 4300 | 313829 | 4653 |
| 23 | KH domain containing, RNA binding, signal transduction associated 1 | 121774 | 492989 | 4301 | 417731 | 4654 |
| 24 | KH domain containing, RNA binding, signal transduction associated 1 | 121774 | 355201 | 4302 | 347336 | 4655 |
| 25 | KH domain containing, RNA binding, signal transduction associated 2 | 112232 | 281156 | 4303 | 281156 | 4656 |
| 26 | KH domain containing, RNA binding, signal transduction associated 2 | 112232 | 539571 | 4304 | 443437 | 4657 |
| 27 | KH domain containing, RNA binding, signal transduction associated 3 | 131773 | 355849 | 4305 | 348108 | 4658 |
| 28 | QKI, KH domain containing, RNA binding | 112531 | 361752 | 4306 | 355094 | 4659 |
| 29 | QKI, KH domain containing, RNA binding | 112531 | 275262 | 4307 | 275262 | 4660 |
| 30 | QKI, KH domain containing, RNA binding | 112531 | 392127 | 4308 | 375973 | 4661 |
| 31 | QKI, KH domain containing, RNA binding | 112531 | 361195 | 4309 | 354867 | 4662 |
| 32 | QKI, KH domain containing, RNA binding | 112531 | 453779 | 4310 | 408775 | 4663 |
| 33 | RALY RNA binding protein-like | 184672 | 522613 | 4311 | 427787 | 4664 |
| 34 | RALY RNA binding protein-like | 184672 | 523850 | 4312 | 428807 | 4665 |
| 35 | RALY RNA binding protein-like | 184672 | 521695 | 4313 | 428667 | 4666 |
| 36 | RALY RNA binding protein-like | 184672 | 521268 | 4314 | 430367 | 4667 |
| 37 | RALY RNA binding protein-like | 184672 | 517988 | 4315 | 428711 | 4668 |
| 38 | RALY RNA binding protein-like | 184672 | 522455 | 4316 | 430394 | 4669 |
| 39 | RD RNA binding protein | 204356 | 375425 | 4317 | 364574 | 4670 |
| 40 | RD RNA binding protein | 204356 | 444811 | 4318 | 388400 | 4671 |
| 41 | RD RNA binding protein | 204356 | 441998 | 4319 | 397914 | 4672 |
| 42 | RD RNA binding protein | 204356 | 375429 | 4320 | 364578 | 4673 |
| 43 | RD RNA binding protein | 204356 | 426722 | 4321 | 394340 | 4674 |
| 44 | RD RNA binding protein | 204356 | 454913 | 4322 | 409389 | 4675 |
| 45 | RD RNA binding protein | 206268 | 411745 | 4323 | 410872 | 4676 |
| 46 | RD RNA binding protein | 206268 | 456281 | 4324 | 396971 | 4677 |
| 47 | RD RNA binding protein | 206268 | 440478 | 4325 | 407528 | 4678 |
| 48 | RD RNA binding protein | 206268 | 383174 | 4326 | 372660 | 4679 |
| 49 | RD RNA binding protein | 206268 | 551833 | 4327 | 447903 | 4680 |
| 50 | RD RNA binding protein | 206268 | 458622 | 4328 | 409139 | 4681 |
| 51 | RD RNA binding protein | 206357 | 548056 | 4329 | 449897 | 4682 |

TABLE 26-continued

RNA binding proteins

| Protein No. | RNA binding protein | ENSG | ENST | ENST SEQ ID NO | ENSP | ENSP SEQ ID NO |
|---|---|---|---|---|---|---|
| 52 | RD RNA binding protein | 206357 | 434518 | 4330 | 409269 | 4683 |
| 53 | RD RNA binding protein | 206357 | 449057 | 4331 | 393793 | 4684 |
| 54 | RD RNA binding protein | 206357 | 383343 | 4332 | 372834 | 4685 |
| 55 | RD RNA binding protein | 206357 | 420039 | 4333 | 411487 | 4686 |
| 56 | RD RNA binding protein | 206357 | 425810 | 4334 | 403630 | 4687 |
| 57 | RD RNA binding protein | 229363 | 549252 | 4335 | 450250 | 4688 |
| 58 | RD RNA binding protein | 229363 | 448628 | 4336 | 394879 | 4689 |
| 59 | RD RNA binding protein | 229363 | 424762 | 4337 | 415567 | 4690 |
| 60 | RD RNA binding protein | 229363 | 418423 | 4338 | 395175 | 4691 |
| 61 | RD RNA binding protein | 229363 | 418059 | 4339 | 401342 | 4692 |
| 62 | RD RNA binding protein | 229363 | 453084 | 4340 | 393794 | 4693 |
| 63 | RD RNA binding protein | 231044 | 443464 | 4341 | 393103 | 4694 |
| 64 | RD RNA binding protein | 231044 | 548988 | 4342 | 449910 | 4695 |
| 65 | RD RNA binding protein | 231044 | 429857 | 4343 | 403623 | 4696 |
| 66 | RD RNA binding protein | 231044 | 437732 | 4344 | 397565 | 4697 |
| 67 | RD RNA binding protein | 231044 | 424967 | 4345 | 411724 | 4698 |
| 68 | RD RNA binding protein | 231044 | 420837 | 4346 | 414014 | 4699 |
| 69 | RD RNA binding protein | 233801 | 456263 | 4347 | 407630 | 4700 |
| 70 | RD RNA binding protein | 233801 | 452147 | 4348 | 401745 | 4701 |
| 71 | RD RNA binding protein | 233801 | 457397 | 4349 | 393005 | 4702 |
| 72 | RD RNA binding protein | 233801 | 552869 | 4350 | 447844 | 4703 |
| 73 | RD RNA binding protein | 233801 | 425721 | 4351 | 390689 | 4704 |
| 74 | RD RNA binding protein | 233801 | 435435 | 4352 | 396604 | 4705 |
| 75 | RNA binding motif (RNP1, RRM) protein 3 | 102317 | 430348 | 4353 | 412764 | 4706 |
| 76 | RNA binding motif (RNP1, RRM) protein 3 | 102317 | 376759 | 4354 | 365950 | 4707 |
| 77 | RNA binding motif (RNP1, RRM) protein 3 | 102317 | 376755 | 4355 | 365946 | 4708 |
| 78 | RNA binding motif (RNP1, RRM) protein 3 | 102317 | 354480 | 4356 | 346473 | 4709 |
| 79 | RNA binding motif protein 10 | 182872 | 377604 | 4357 | 366829 | 4710 |
| 80 | RNA binding motif protein 10 | 182872 | 329236 | 4358 | 328848 | 4711 |
| 81 | RNA binding motif protein 10 | 182872 | 345781 | 4359 | 329659 | 4712 |
| 82 | RNA binding motif protein 11 | 185272 | 400577 | 4360 | 383421 | 4713 |
| 83 | RNA binding motif protein 12 | 244462 | 359646 | 4361 | 352668 | 4714 |
| 84 | RNA binding motif protein 12 | 244462 | 374104 | 4362 | 363217 | 4715 |
| 85 | RNA binding motif protein 12 | 244462 | 374114 | 4363 | 363228 | 4716 |
| 86 | RNA binding motif protein 12 | 244462 | 431148 | 4364 | 392642 | 4717 |
| 87 | RNA binding motif protein 12 | 244462 | 424458 | 4365 | 411036 | 4718 |
| 88 | RNA binding motif protein 12 | 244462 | 435161 | 4366 | 411692 | 4719 |
| 89 | RNA binding motif protein 12 | 244462 | 349942 | 4367 | 339879 | 4720 |
| 90 | RNA binding motif protein 12B | 183808 | 518597 | 4368 | 428269 | 4721 |
| 91 | RNA binding motif protein 12B | 183808 | 399300 | 4369 | 382239 | 4722 |
| 92 | RNA binding motif protein 12B | 183808 | 520560 | 4370 | 429807 | 4723 |
| 93 | RNA binding motif protein 12B | 183808 | 521947 | 4371 | 430466 | 4724 |
| 94 | RNA binding motif protein 12B | 183808 | 517700 | 4372 | 427729 | 4725 |
| 95 | RNA binding motif protein 12B | 183808 | 519109 | 4373 | 430474 | 4726 |
| 96 | RNA binding motif protein 14 | 239306 | 310137 | 4374 | 311747 | 4727 |
| 97 | RNA binding motif protein 15 | 162775 | 369784 | 4375 | 358799 | 4728 |
| 98 | RNA binding motif protein 15B | 179837 | 323686 | 4376 | 313890 | 4729 |
| 99 | RNA binding motif protein 15B | 179837 | 536338 | 4377 | 444388 | 4730 |
| 100 | RNA binding motif protein 15B | 179837 | 541145 | 4378 | 443941 | 4731 |
| 101 | RNA binding motif protein 15B | 179837 | 540284 | 4379 | 437933 | 4732 |
| 102 | RNA binding motif protein 17 | 134453 | 447032 | 4380 | 406024 | 4733 |
| 103 | RNA binding motif protein 17 | 134453 | 437845 | 4381 | 395448 | 4734 |
| 104 | RNA binding motif protein 17 | 134453 | 372795 | 4382 | 361881 | 4735 |
| 105 | RNA binding motif protein 17 | 134453 | 418631 | 4383 | 402303 | 4736 |
| 106 | RNA binding motif protein 17 | 134453 | 432931 | 4384 | 408214 | 4737 |
| 107 | RNA binding motif protein 17 | 134453 | 379888 | 4385 | 369218 | 4738 |
| 108 | RNA binding motif protein 17 | 134453 | 446108 | 4386 | 388638 | 4739 |
| 109 | RNA binding motif protein 18 | 119446 | 417201 | 4387 | 409315 | 4740 |
| 110 | RNA binding motif protein 19 | 122965 | 545145 | 4388 | 442053 | 4741 |
| 111 | RNA binding motif protein 19 | 122965 | 261741 | 4389 | 261741 | 4742 |
| 112 | RNA binding motif protein 19 | 122965 | 392561 | 4390 | 376344 | 4743 |
| 113 | RNA binding motif protein 20 | 203867 | 539821 | 4391 | 446400 | 4744 |
| 114 | RNA binding motif protein 20 | 203867 | 369519 | 4392 | 358532 | 4745 |
| 115 | RNA binding motif protein 22 | 86589 | 447771 | 4393 | 412118 | 4746 |
| 116 | RNA binding motif protein 22 | 86589 | 199814 | 4394 | 199814 | 4747 |
| 117 | RNA binding motif protein 22 | 86589 | 540000 | 4395 | 441594 | 4748 |
| 118 | RNA binding motif protein 23 | 100461 | 399922 | 4396 | 382806 | 4749 |
| 119 | RNA binding motif protein 23 | 100461 | 359890 | 4397 | 352956 | 4750 |
| 120 | RNA binding motif protein 23 | 100461 | 346528 | 4398 | 339220 | 4751 |
| 121 | RNA binding motif protein 23 | 100461 | 554618 | 4399 | 451448 | 4752 |
| 122 | RNA binding motif protein 23 | 100461 | 553876 | 4400 | 450672 | 4753 |

TABLE 26-continued

| | RNA binding proteins | | | | | |
|---|---|---|---|---|---|---|
| Protein No. | RNA binding protein | ENSG | ENST | ENST SEQ ID NO | ENSP | ENSP SEQ ID NO |
| 123 | RNA binding motif protein 23 | 100461 | 557571 | 4401 | 452382 | 4754 |
| 124 | RNA binding motif protein 23 | 100461 | 557549 | 4402 | 450558 | 4755 |
| 125 | RNA binding motif protein 23 | 100461 | 338980 | 4403 | 345496 | 4756 |
| 126 | RNA binding motif protein 23 | 100461 | 554256 | 4404 | 452583 | 4757 |
| 127 | RNA binding motif protein 23 | 100461 | 557464 | 4405 | 451403 | 4758 |
| 128 | RNA binding motif protein 23 | 100461 | 555691 | 4406 | 452538 | 4759 |
| 129 | RNA binding motif protein 23 | 100461 | 556862 | 4407 | 452557 | 4760 |
| 130 | RNA binding motif protein 23 | 100461 | 555676 | 4408 | 451364 | 4761 |
| 131 | RNA binding motif protein 24 | 112183 | 379052 | 4409 | 368341 | 4762 |
| 132 | RNA binding motif protein 24 | 112183 | 318204 | 4410 | 319551 | 4763 |
| 133 | RNA binding motif protein 24 | 112183 | 425446 | 4411 | 396898 | 4764 |
| 134 | RNA binding motif protein 25 | 119707 | 525161 | 4412 | 434004 | 4765 |
| 135 | RNA binding motif protein 25 | 119707 | 525321 | 4413 | 436868 | 4766 |
| 136 | RNA binding motif protein 25 | 119707 | 531500 | 4414 | 434333 | 4767 |
| 137 | RNA binding motif protein 25 | 119707 | 261973 | 4415 | 261973 | 4768 |
| 138 | RNA binding motif protein 25 | 119707 | 527432 | 4416 | 431150 | 4769 |
| 139 | RNA binding motif protein 25 | 119707 | 526754 | 4417 | 436225 | 4770 |
| 140 | RNA binding motif protein 25 | 119707 | 540173 | 4418 | 437934 | 4771 |
| 141 | RNA binding motif protein 26 | 139746 | 267229 | 4419 | 267229 | 4772 |
| 142 | RNA binding motif protein 26 | 139746 | 327303 | 4420 | 327080 | 4773 |
| 143 | RNA binding motif protein 26 | 139746 | 438724 | 4421 | 390222 | 4774 |
| 144 | RNA binding motif protein 27 | 91009 | 265271 | 4422 | 265271 | 4775 |
| 145 | RNA binding motif protein 28 | 106344 | 223073 | 4423 | 223073 | 4776 |
| 146 | RNA binding motif protein 33 | 184863 | 438356 | 4424 | 405793 | 4777 |
| 147 | RNA binding motif protein 33 | 184863 | 287912 | 4425 | 287912 | 4778 |
| 148 | RNA binding motif protein 33 | 184863 | 401878 | 4426 | 384160 | 4779 |
| 149 | RNA binding motif protein 33 | 184863 | 341148 | 4427 | 341583 | 4780 |
| 150 | RNA binding motif protein 34 | 188739 | 408888 | 4428 | 386226 | 4781 |
| 151 | RNA binding motif protein 34 | 188739 | 400947 | 4429 | 383731 | 4782 |
| 152 | RNA binding motif protein 34 | 188739 | 429912 | 4430 | 413409 | 4783 |
| 153 | RNA binding motif protein 34 | 188739 | 366606 | 4431 | 355565 | 4784 |
| 154 | RNA binding motif protein 38 | 132819 | 356208 | 4432 | 348538 | 4785 |
| 155 | RNA binding motif protein 38 | 132819 | 440234 | 4433 | 407848 | 4786 |
| 156 | RNA binding motif protein 38 | 132819 | 371219 | 4434 | 360263 | 4787 |
| 157 | RNA binding motif protein 39 | 131051 | 253363 | 4435 | 253363 | 4788 |
| 158 | RNA binding motif protein 39 | 131051 | 407261 | 4436 | 384541 | 4789 |
| 159 | RNA binding motif protein 39 | 131051 | 361162 | 4437 | 354437 | 4790 |
| 160 | RNA binding motif protein 39 | 131051 | 448303 | 4438 | 394824 | 4791 |
| 161 | RNA binding motif protein 39 | 131051 | 374038 | 4439 | 363150 | 4792 |
| 162 | RNA binding motif protein 39 | 131051 | 528062 | 4440 | 436747 | 4793 |
| 163 | RNA binding motif protein 39 | 131051 | 338163 | 4441 | 344581 | 4794 |
| 164 | RNA binding motif protein 39 | 131051 | 434927 | 4442 | 393493 | 4795 |
| 165 | RNA binding motif protein 4 | 173933 | 532968 | 4443 | 432020 | 4796 |
| 166 | RNA binding motif protein 4 | 173933 | 408993 | 4444 | 386561 | 4797 |
| 167 | RNA binding motif protein 4 | 173933 | 409406 | 4445 | 386894 | 4798 |
| 168 | RNA binding motif protein 4 | 173933 | 483858 | 4446 | 435821 | 4799 |
| 169 | RNA binding motif protein 4 | 173933 | 310092 | 4447 | 309166 | 4800 |
| 170 | RNA binding motif protein 41 | 89682 | 434854 | 4448 | 405522 | 4801 |
| 171 | RNA binding motif protein 41 | 89682 | 372479 | 4449 | 361557 | 4802 |
| 172 | RNA binding motif protein 41 | 89682 | 372487 | 4450 | 361565 | 4803 |
| 173 | RNA binding motif protein 41 | 89682 | 372482 | 4451 | 361560 | 4804 |
| 174 | RNA binding motif protein 41 | 89682 | 203616 | 4452 | 203616 | 4805 |
| 175 | RNA binding motif protein 42 | 126254 | 262633 | 4453 | 262633 | 4806 |
| 176 | RNA binding motif protein 42 | 126254 | 360475 | 4454 | 353663 | 4807 |
| 177 | RNA binding motif protein 43 | 184898 | 331426 | 4455 | 331211 | 4808 |
| 178 | RNA binding motif protein 44 | 177483 | 316997 | 4456 | 321179 | 4809 |
| 179 | RNA binding motif protein 44 | 177483 | 409864 | 4457 | 386727 | 4810 |
| 180 | RNA binding motif protein 45 | 155636 | 286070 | 4458 | 286070 | 4811 |
| 181 | RNA binding motif protein 45 | 155636 | 455903 | 4459 | 415940 | 4812 |
| 182 | RNA binding motif protein 46 | 151962 | 281722 | 4460 | 281722 | 4813 |
| 183 | RNA binding motif protein 47 | 163694 | 295971 | 4461 | 295971 | 4814 |
| 184 | RNA binding motif protein 47 | 163694 | 381793 | 4462 | 371212 | 4815 |
| 185 | RNA binding motif protein 47 | 163694 | 511902 | 4463 | 425111 | 4816 |
| 186 | RNA binding motif protein 47 | 163694 | 515053 | 4464 | 422564 | 4817 |
| 187 | RNA binding motif protein 47 | 163694 | 511598 | 4465 | 424019 | 4818 |
| 188 | RNA binding motif protein 47 | 163694 | 513473 | 4466 | 421589 | 4819 |
| 189 | RNA binding motif protein 47 | 163694 | 505414 | 4467 | 423527 | 4820 |
| 190 | RNA binding motif protein 47 | 163694 | 514782 | 4468 | 426542 | 4821 |
| 191 | RNA binding motif protein 47 | 163694 | 319592 | 4469 | 320108 | 4822 |
| 192 | RNA binding motif protein 47 | 163694 | 507180 | 4470 | 423398 | 4823 |
| 193 | RNA binding motif protein 47 | 163694 | 381795 | 4471 | 371214 | 4824 |
| 194 | RNA binding motif protein 47 | 163694 | 505220 | 4472 | 425507 | 4825 |
| 195 | RNA binding motif protein 48 | 127993 | 509224 | 4473 | 442073 | 4826 |
| 196 | RNA binding motif protein 48 | 127993 | 450580 | 4474 | 401920 | 4827 |
| 197 | RNA binding motif protein 48 | 127993 | 265732 | 4475 | 265732 | 4828 |

TABLE 26-continued

RNA binding proteins

| Protein No. | RNA binding protein | ENSG | ENST | ENST SEQ ID NO | ENSP | ENSP SEQ ID NO |
|---|---|---|---|---|---|---|
| 198 | RNA binding motif protein 4B | 173914 | 525754 | 4476 | 433071 | 4829 |
| 199 | RNA binding motif protein 4B | 173914 | 310046 | 4477 | 310471 | 4830 |
| 200 | RNA binding motif protein 5 | 3756 | 469838 | 4478 | 419534 | 4831 |
| 201 | RNA binding motif protein 5 | 3756 | 347869 | 4479 | 343054 | 4832 |
| 202 | RNA binding motif protein 5 | 3756 | 441305 | 4480 | 390711 | 4833 |
| 203 | RNA binding motif protein 5 | 3756 | 543047 | 4481 | 442591 | 4834 |
| 204 | RNA binding motif protein 5 | 3756 | 536082 | 4482 | 445347 | 4835 |
| 205 | RNA binding motif protein 5 | 3756 | 417905 | 4483 | 406119 | 4836 |
| 206 | RNA binding motif protein 5 | 3756 | 437500 | 4484 | 394622 | 4837 |
| 207 | RNA binding motif protein 5 | 3756 | 544851 | 4485 | 439808 | 4838 |
| 208 | RNA binding motif protein 5 | 3756 | 539538 | 4486 | 440744 | 4839 |
| 209 | RNA binding motif protein 6 | 4534 | 422955 | 4487 | 392939 | 4840 |
| 210 | RNA binding motif protein 6 | 4534 | 442092 | 4488 | 393530 | 4841 |
| 211 | RNA binding motif protein 6 | 4534 | 425608 | 4489 | 408665 | 4842 |
| 212 | RNA binding motif protein 6 | 4534 | 443081 | 4490 | 396466 | 4843 |
| 213 | RNA binding motif protein 6 | 4534 | 416583 | 4491 | 390202 | 4844 |
| 214 | RNA binding motif protein 6 | 4534 | 433811 | 4492 | 389763 | 4845 |
| 215 | RNA binding motif protein 6 | 4534 | 539992 | 4493 | 443165 | 4846 |
| 216 | RNA binding motif protein 6 | 4534 | 266022 | 4494 | 266022 | 4847 |
| 217 | RNA binding motif protein 7 | 76053 | 540163 | 4495 | 439918 | 4848 |
| 218 | RNA binding motif protein 8A | 131795 | 369307 | 4496 | 358313 | 4849 |
| 219 | RNA binding motif protein 8A | 131795 | 330165 | 4497 | 333001 | 4850 |
| 220 | RNA binding motif protein, X-linked | 147274 | 449161 | 4498 | 415250 | 4851 |
| 221 | RNA binding motif protein, X-linked | 147274 | 320676 | 4499 | 359645 | 4852 |
| 222 | RNA binding motif protein, X-linked | 147274 | 419968 | 4500 | 405117 | 4853 |
| 223 | RNA binding motif protein, X-linked | 147274 | 431446 | 4501 | 411989 | 4854 |
| 224 | RNA binding motif protein, X-linked 2 | 134597 | 305536 | 4502 | 339090 | 4855 |
| 225 | RNA binding motif protein, X-linked 2 | 134597 | 370947 | 4503 | 359985 | 4856 |
| 226 | RNA binding motif protein, X-linked 2 | 134597 | 538614 | 4504 | 437425 | 4857 |
| 227 | RNA binding motif protein, X-linked-like 1 | 213516 | 399794 | 4505 | 446099 | 4858 |
| 228 | RNA binding motif protein, X-linked-like 1 | 213516 | 321792 | 4506 | 318415 | 4859 |
| 229 | RNA binding motif protein, X-linked-like 2 | 170748 | 306904 | 4507 | 304139 | 4860 |
| 230 | RNA binding motif protein, X-linked-like 3 | 175718 | 424776 | 4508 | 417451 | 4861 |
| 231 | RNA binding motif protein, Y-linked, family 1, member A1 | 234414 | 382707 | 4509 | 372154 | 4862 |
| 232 | RNA binding motif protein, Y-linked, family 1, member A1 | 234414 | 439108 | 4510 | 388006 | 4863 |
| 233 | RNA binding motif protein, Y-linked, family 1, member A1 | 234414 | 303902 | 4511 | 303712 | 4864 |
| 234 | RNA binding motif protein, Y-linked, family 1, member B | 242875 | 383020 | 4512 | 372484 | 4865 |
| 235 | RNA binding motif protein, Y-linked, family 1, member D | 244395 | 418956 | 4513 | 399181 | 4866 |
| 236 | RNA binding motif protein, Y-linked, family 1, member D | 244395 | 382680 | 4514 | 372127 | 4867 |
| 237 | RNA binding motif protein, Y-linked, family 1, member D | 244395 | 382677 | 4515 | 372124 | 4868 |
| 238 | RNA binding motif protein, Y-linked, family 1, member E | 242389 | 382658 | 4516 | 372104 | 4869 |
| 239 | RNA binding motif protein, Y-linked, family 1, member E | 242389 | 382659 | 4517 | 372105 | 4870 |
| 240 | RNA binding motif protein, Y-linked, family 1, member E | 242389 | 382673 | 4518 | 372119 | 4871 |
| 241 | RNA binding motif protein, Y-linked, family 1, member F | 169800 | 303766 | 4519 | 307155 | 4872 |
| 242 | RNA binding motif protein, Y-linked, family 1, member F | 169800 | 454978 | 4520 | 406005 | 4873 |
| 243 | RNA binding motif protein, Y-linked, family 1, member J | 226941 | 414629 | 4521 | 405745 | 4874 |
| 244 | RNA binding motif protein, Y-linked, family 1, member J | 226941 | 250831 | 4522 | 250831 | 4875 |
| 245 | RNA binding motif protein, Y-linked, family 1, member J | 226941 | 445779 | 4523 | 389621 | 4876 |

TABLE 26-continued

| | RNA binding proteins | | | | | |
|---|---|---|---|---|---|---|
| Protein No. | RNA binding protein | ENSG | ENST | ENST SEQ ID NO | ENSP | ENSP SEQ ID NO |
| 246 | RNA binding motif, single stranded interacting protein 1 | 153250 | 348849 | 4524 | 294904 | 4877 |
| 247 | RNA binding motif, single stranded interacting protein 1 | 153250 | 428519 | 4525 | 389016 | 4878 |
| 248 | RNA binding motif, single stranded interacting protein 1 | 153250 | 409075 | 4526 | 386347 | 4879 |
| 249 | RNA binding motif, single stranded interacting protein 1 | 153250 | 409972 | 4527 | 387280 | 4880 |
| 250 | RNA binding motif, single stranded interacting protein 1 | 153250 | 392753 | 4528 | 376508 | 4881 |
| 251 | RNA binding motif, single stranded interacting protein 1 | 153250 | 409289 | 4529 | 386571 | 4882 |
| 252 | RNA binding motif, single stranded interacting protein 2 | 76067 | 262031 | 4530 | 262031 | 4883 |
| 253 | RNA binding motif, single stranded interacting protein 3 | 144642 | 434693 | 4531 | 395592 | 4884 |
| 254 | RNA binding motif, single stranded interacting protein 3 | 144642 | 383767 | 4532 | 373277 | 4885 |
| 255 | RNA binding motif, single stranded interacting protein 3 | 144642 | 383766 | 4533 | 373276 | 4886 |
| 256 | RNA binding motif, single stranded interacting protein 3 | 144642 | 456853 | 4534 | 400519 | 4887 |
| 257 | RNA binding motif, single stranded interacting protein 3 | 144642 | 396583 | 4535 | 379828 | 4888 |
| 258 | RNA binding motif, single stranded interacting protein 3 | 144642 | 273139 | 4536 | 273139 | 4889 |
| 259 | RNA binding protein S1, serine-rich domain | 205937 | 320225 | 4537 | 315859 | 4890 |
| 260 | RNA binding protein S1, serine-rich domain | 205937 | 301730 | 4538 | 301730 | 4891 |
| 261 | RNA binding protein S1, serine-rich domain | 205937 | 397086 | 4539 | 380275 | 4892 |
| 262 | RNA binding protein with multiple splicing | 157110 | 320203 | 4540 | 318102 | 4893 |
| 263 | RNA binding protein with multiple splicing | 157110 | 287771 | 4541 | 287771 | 4894 |
| 264 | RNA binding protein with multiple splicing | 157110 | 339877 | 4542 | 340176 | 4895 |
| 265 | RNA binding protein with multiple splicing | 157110 | 538486 | 4543 | 445406 | 4896 |
| 266 | RNA binding protein with multiple splicing | 157110 | 397323 | 4544 | 380486 | 4897 |
| 267 | RNA binding protein with multiple splicing 2 | 166831 | 300069 | 4545 | 300069 | 4898 |
| 268 | RNA binding protein, autoantigenic (hnRNP-associated with lethal yellow homolog (mouse)) | 125970 | 246194 | 4546 | 246194 | 4899 |
| 269 | RNA binding protein, autoantigenic (hnRNP-associated with lethal yellow homolog (mouse)) | 125970 | 442805 | 4547 | 415973 | 4900 |
| 270 | RNA binding protein, autoantigenic (hnRNP-associated with lethal yellow homolog (mouse)) | 125970 | 448364 | 4548 | 413638 | 4901 |
| 271 | RNA binding protein, autoantigenic (hnRNP-associated with lethal yellow homolog (mouse)) | 125970 | 413297 | 4549 | 403744 | 4902 |
| 272 | RNA binding protein, autoantigenic (hnRNP-associated with lethal yellow homolog (mouse)) | 125970 | 375114 | 4550 | 364255 | 4903 |
| 273 | RNA binding protein, fox-1 homolog (*C. elegans*) 1 | 78328 | 311745 | 4551 | 309117 | 4904 |
| 274 | RNA binding protein, fox-1 homolog (*C. elegans*) 1 | 78328 | 550418 | 4552 | 450031 | 4905 |
| 275 | RNA binding protein, fox-1 homolog (*C. elegans*) 1 | 78328 | 355637 | 4553 | 347855 | 4906 |
| 276 | RNA binding protein, fox-1 homolog (*C. elegans*) 1 | 78328 | 553186 | 4554 | 447753 | 4907 |
| 277 | RNA binding protein, fox-1 homolog (*C. elegans*) 1 | 78328 | 436368 | 4555 | 402745 | 4908 |

TABLE 26-continued

| Protein No. | RNA binding protein | ENSG | ENST | ENST SEQ ID NO | ENSP | ENSP SEQ ID NO |
|---|---|---|---|---|---|---|
| 278 | RNA binding protein, fox-1 homolog (C. elegans) 1 | 78328 | 352951 | 4556 | 322925 | 4909 |
| 279 | RNA binding protein, fox-1 homolog (C. elegans) 1 | 78328 | 340209 | 4557 | 344196 | 4910 |
| 280 | RNA binding protein, fox-1 homolog (C. elegans) 1 | 78328 | 547338 | 4558 | 447717 | 4911 |
| 281 | RNA binding protein, fox-1 homolog (C. elegans) 1 | 78328 | 547372 | 4559 | 446842 | 4912 |
| 282 | RNA binding protein, fox-1 homolog (C. elegans) 1 | 78328 | 551752 | 4560 | 447281 | 4913 |
| 283 | RNA binding protein, fox-1 homolog (C. elegans) 2 | 100320 | 397303 | 4561 | 380470 | 4914 |
| 284 | RNA binding protein, fox-1 homolog (C. elegans) 2 | 100320 | 397305 | 4562 | 380472 | 4915 |
| 285 | RNA binding protein, fox-1 homolog (C. elegans) 2 | 100320 | 338644 | 4563 | 342831 | 4916 |
| 286 | RNA binding protein, fox-1 homolog (C. elegans) 2 | 100320 | 408983 | 4564 | 386177 | 4917 |
| 287 | RNA binding protein, fox-1 homolog (C. elegans) 2 | 100320 | 438146 | 4565 | 413035 | 4918 |
| 288 | RNA binding protein, fox-1 homolog (C. elegans) 2 | 100320 | 359369 | 4566 | 352328 | 4919 |
| 289 | RNA binding protein, fox-1 homolog (C. elegans) 2 | 100320 | 262829 | 4567 | 262829 | 4920 |
| 290 | RNA binding protein, fox-1 homolog (C. elegans) 2 | 100320 | 405409 | 4568 | 384944 | 4921 |
| 291 | RNA binding protein, fox-1 homolog (C. elegans) 2 | 100320 | 449924 | 4569 | 391670 | 4922 |
| 292 | RNA binding protein, fox-1 homolog (C. elegans) 2 | 100320 | 414461 | 4570 | 407855 | 4923 |
| 293 | RNA binding protein, fox-1 homolog (C. elegans) 2 | 100320 | 416721 | 4571 | 405651 | 4924 |
| 294 | RNA binding protein, fox-1 homolog (C. elegans) 3 | 167281 | 415831 | 4572 | 408395 | 4925 |
| 295 | RNA binding protein, fox-1 homolog (C. elegans) 3 | 167281 | 453134 | 4573 | 393262 | 4926 |
| 296 | S1 RNA binding domain 1 | 68784 | 535761 | 4574 | 263736 | 4927 |
| 297 | S1 RNA binding domain 1 | 68784 | 263736 | 4575 | 441272 | 4928 |
| 298 | SERPINE1 mRNA binding protein 1 | 142864 | 370995 | 4576 | 360034 | 4929 |
| 299 | SERPINE1 mRNA binding protein 1 | 142864 | 361219 | 4577 | 354591 | 4930 |
| 300 | SERPINE1 mRNA binding protein 1 | 142864 | 370994 | 4578 | 360033 | 4931 |
| 301 | SERPINE1 mRNA binding protein 1 | 142864 | 370990 | 4579 | 360029 | 4932 |
| 302 | signal recognition particle 14 kDa (homologous Alu RNA binding protein) | 140319 | 267884 | 4580 | 267884 | 4933 |
| 303 | spermatid perinuclear RNA binding protein | 165209 | 407982 | 4581 | 384292 | 4934 |
| 304 | spermatid perinuclear RNA binding protein | 165209 | 348403 | 4582 | 321347 | 4935 |
| 305 | spermatid perinuclear RNA binding protein | 165209 | 479114 | 4583 | 431531 | 4936 |
| 306 | spermatid perinuclear RNA binding protein | 165209 | 447404 | 4584 | 415968 | 4937 |
| 307 | spermatid perinuclear RNA binding protein | 165209 | 360998 | 4585 | 354271 | 4938 |
| 308 | SRA stem-loop interacting RNA binding protein | 119705 | 557342 | 4586 | 450909 | 4939 |
| 309 | staufen, RNA binding protein, homolog 1 (Drosophila) | 124214 | 371856 | 4587 | 360922 | 4940 |
| 310 | staufen, RNA binding protein, homolog 1 (Drosophila) | 124214 | 360426 | 4588 | 353604 | 4941 |
| 311 | staufen, RNA binding protein, homolog 1 (Drosophila) | 124214 | 371828 | 4589 | 360893 | 4942 |
| 312 | staufen, RNA binding protein, homolog 1 (Drosophila) | 124214 | 371805 | 4590 | 360870 | 4943 |
| 313 | staufen, RNA binding protein, homolog 1 (Drosophila) | 124214 | 371802 | 4591 | 360867 | 4944 |
| 314 | staufen, RNA binding protein, homolog 1 (Drosophila) | 124214 | 456866 | 4592 | 398785 | 4945 |
| 315 | staufen, RNA binding protein, homolog 1 (Drosophila) | 124214 | 347458 | 4593 | 323443 | 4946 |

TABLE 26-continued

| | RNA binding proteins | | | | | |
|---|---|---|---|---|---|---|
| Protein No. | RNA binding protein | ENSG | ENST | ENST SEQ ID NO | ENSP | ENSP SEQ ID NO |
| 316 | staufen, RNA binding protein, homolog 1 (*Drosophila*) | 124214 | 340954 | 4594 | 345425 | 4947 |
| 317 | staufen, RNA binding protein, homolog 1 (*Drosophila*) | 124214 | 371792 | 4595 | 360857 | 4948 |
| 318 | staufen, RNA binding protein, homolog 1 (*Drosophila*) | 124214 | 437404 | 4596 | 416779 | 4949 |
| 319 | staufen, RNA binding protein, homolog 2 (*Drosophila*) | 40341 | 355780 | 4597 | 348026 | 4950 |
| 320 | staufen, RNA binding protein, homolog 2 (*Drosophila*) | 40341 | 524300 | 4598 | 428756 | 4951 |
| 321 | staufen, RNA binding protein, homolog 2 (*Drosophila*) | 40341 | 524104 | 4599 | 430611 | 4952 |
| 322 | staufen, RNA binding protein, homolog 2 (*Drosophila*) | 40341 | 522695 | 4600 | 428456 | 4953 |
| 323 | staufen, RNA binding protein, homolog 2 (*Drosophila*) | 40341 | 522509 | 4601 | 427977 | 4954 |
| 324 | staufen, RNA binding protein, homolog 2 (*Drosophila*) | 40341 | 521736 | 4602 | 428737 | 4955 |
| 325 | staufen, RNA binding protein, homolog 2 (*Drosophila*) | 40341 | 521447 | 4603 | 428829 | 4956 |
| 326 | TAR (HIV-1) RNA binding protein 1 | 59588 | 40877 | 4604 | 40877 | 4957 |
| 327 | TAR (HIV-1) RNA binding protein 2 | 139546 | 456234 | 4605 | 416077 | 4958 |
| 328 | TAR (HIV-1) RNA binding protein 2 | 139546 | 266987 | 4606 | 266987 | 4959 |
| 329 | TIA1 cytotoxic granule-associated RNA binding protein | 116001 | 433529 | 4607 | 401371 | 4960 |
| 330 | TIA1 cytotoxic granule-associated RNA binding protein | 116001 | 477807 | 4608 | 445092 | 4961 |
| 331 | TIA1 cytotoxic granule-associated RNA binding protein | 116001 | 415783 | 4609 | 404023 | 4962 |
| 332 | TIA1 cytotoxic granule-associated RNA binding protein-like 1 | 151923 | 412524 | 4610 | 403573 | 4963 |
| 333 | TIA1 cytotoxic granule-associated RNA binding protein-like 1 | 151923 | 436547 | 4611 | 394902 | 4964 |
| 334 | TIA1 cytotoxic granule-associated RNA binding protein-like 1 | 151923 | 369086 | 4612 | 358082 | 4965 |
| 335 | TIA1 cytotoxic granule-associated RNA binding protein-like 1 | 151923 | 369093 | 4613 | 358089 | 4966 |
| 336 | TIA1 cytotoxic granule-associated RNA binding protein-like 1 | 151923 | 369092 | 4614 | 358088 | 4967 |
| 337 | zinc finger CCHC-type and RNA binding motif 1 | 139168 | 266529 | 4615 | 266529 | 4968 |
| 338 | zinc finger RNA binding protein | 56097 | 265069 | 4616 | 265069 | 4969 |
| 339 | zinc finger RNA binding protein | 56097 | 416900 | 4617 | 393243 | 4970 |
| 340 | zinc finger RNA binding protein | 56097 | 382126 | 4618 | 371560 | 4971 |
| 341 | zinc finger RNA binding protein 2 | 105278 | 439086 | 4619 | 388567 | 4972 |
| 342 | zinc finger RNA binding protein 2 | 105278 | 262961 | 4620 | 262961 | 4973 |
| 343 | zinc finger RNA binding protein 2 | 105278 | 438164 | 4621 | 388974 | 4974 |
| 344 | cold shock domain containing E1, RNA-binding | 9307 | 261443 | 4622 | 261443 | 4975 |
| 345 | cold shock domain containing E1, RNA-binding | 9307 | 339438 | 4623 | 342408 | 4976 |
| 346 | cold shock domain containing E1, RNA-binding | 9307 | 358528 | 4624 | 351329 | 4977 |
| 347 | cold shock domain containing E1, RNA-binding | 9307 | 369530 | 4625 | 358543 | 4978 |
| 348 | cold shock domain containing E1, RNA-binding | 9307 | 438362 | 4626 | 407724 | 4979 |
| 349 | cold shock domain containing E1, RNA-binding | 9307 | 525878 | 4627 | 431562 | 4980 |
| 350 | cold shock domain containing E1, RNA-binding | 9307 | 525970 | 4628 | 432805 | 4981 |
| 351 | cold shock domain containing E1, RNA-binding | 9307 | 530886 | 4629 | 431297 | 4982 |
| 352 | cold shock domain containing E1, RNA-binding | 9307 | 534389 | 4630 | 435185 | 4983 |

TABLE 26-continued

RNA binding proteins

| Protein No. | RNA binding protein | ENSG | ENST | ENST SEQ ID NO | ENSP | ENSP SEQ ID NO |
|---|---|---|---|---|---|---|
| 353 | cold shock domain containing E1, RNA-binding | 9307 | 534699 | 4631 | 432958 | 4984 |

HuR is a stabilizing AREBP. To increase the stability of the mRNA of interest, an mRNA encoding HuR can be co-transfected or co-injected along with the mRNA of interest into the cells or into the tissue. These proteins can also be tethered to the mRNA of interest in vitro and then administered to the cells together. Poly A tail binding protein, PABP interacts with eukaryotic translation initiation factor eIF4G to stimulate translational initiation. Co-administration of mRNAs encoding these RBPs along with the mRNA drug and/or tethering these proteins to the mRNA drug in vitro and administering the protein-bound mRNA into the cells can increase the translational efficiency of the mRNA. The same concept can be extended to co-administration of mRNA along with mRNAs encoding various translation factors and facilitators as well as with the proteins themselves to influence RNA stability and/or translational efficiency.

Example 24

Expression of Modified Nucleic Acid with microRNA Binding Site

Human embryonic kidney epithelial cells (HEK293A), antigen presenting cells or cell lines with highly expressed mir-142/146, such as monocyte-derived dendritic cells (MDDC) or PBMC, are seeded at a density of 200,000 per well in 500 ul cell culture medium (InVitro GRO medium from Celsis, Chicago, Ill.). G-CSF mRNA (mRNA sequence is shown in SEQ ID NO: 4258; polyA tail of at least 140 nucleotides not shown in sequence; 5'Cap, Cap1) G-CSF mRNA having a miR-142-5p binding site (G-CSF miR-142-5p) (cDNA sequence is shown in SEQ ID NO: 4985; mRNA sequence is shown in SEQ ID NO: 4986, polyA tail of at least 140 nucleotides not shown in sequence; 5'Cap, Cap1), G-CSF mRNA having a seed sequence from miR-142-5p binding site (G-CSF miR-142-5p-seed) (cDNA sequence is shown in SEQ ID NO: 4987; mRNA sequence is shown in SEQ ID NO: 4988; polyA tail of at least 140 nucleotides not shown in sequence; 5'Cap, Cap1) G-CSF mRNA having a miR-142-5p binding site without the seed sequence (G-CSF miR-142-5p-seedless) (cDNA sequence is shown in SEQ ID NO: 4989, mRNA sequence is shown in SEQ ID NO: 4990; polyA tail of at least 140 nucleotides not shown in sequence; 5'Cap, Cap1) G-CSF mRNA having a miR-142-3p binding site (G-CSF miR-142-3p) (cDNA sequence is shown in SEQ ID NO: 4991; mRNA sequence is shown in SEQ ID NO: 4992; polyA tail of at least 140 nucleotides not shown in sequence; 5'Cap, Cap1) G-CSF mRNA having a seed sequence from miR-142-3p binding site (G-CSF miR-142-3p-seed) (cDNA sequence is shown in SEQ ID NO: 4993; mRNA sequence is shown in SEQ ID NO: 4994; polyA tail of at least 140 nucleotides not shown in sequence; 5'Cap, Cap1) G-CSF mRNA having a miR-142-3p binding site without the seed sequence (G-CSF miR-142-3p-seedless) (DNA sequence is shown in SEQ ID NO: 4995; mRNA sequence is shown in SEQ ID NO: 4996; polyA tail of at least 140 nucleotides not shown in sequence; 5'Cap, Cap1) G-CSF mRNA having a miR-146a binding site (G-CSF miR-146a) (cDNA sequence is shown in SEQ ID NO: 4997; mRNA sequence is shown in SEQ ID NO: 4998; polyA tail of at least 140 nucleotides not shown in sequence; 5'Cap, Cap1) G-CSF mRNA having a seed sequence from miR-146a binding site (G-CSF miR-146a-seed) (cDNA sequence is shown in SEQ ID NO:4999; mRNA sequence is shown in SEQ ID NO: 5000; polyA tail at least 140 nucleotides not shown in sequence; 5'Cap, Cap1) or G-CSF mRNA having a miR-146a binding site without the seed sequence (G-CSF miR-146a-seedless) (cDNA sequence is shown in SEQ ID NO: 5001; mRNA sequence is shown in SEQ ID NO: 5002; polyA tail at least nucleotides not shown in sequence; 5'Cap, Cap1) are tested at a concentration of 250 ng per well in 24 well plates. The mRNA sequences are evaluated with various chemical modifications described herein and/or known in the art including, fully modified with 5-methylcytidine and pseudouridine, fully modified with 5-methylcytidine and 1-methylpseudouridine, fully modified with pseudouridine, fully modified with 1-methylpseudouridine and where 25% of the uridine residues are modified with 2-thiouridine and 25% of the cytosine residues are modified with 5-methylcytidine. The expression of G-CSF in each sample is measured by ELISA.

Shown in Table 27 are the DNA and mRNA G-CSF sequences with the miR binding sites described above. In the table, the start codon of each sequence is underlined.

TABLE 27

G-CSF Constructs with miR binding sites

| SEQ ID NO. | Description | SEQ |
|---|---|---|
| 4985 | DNA sequence having the T7 polymerase site and restriction | TAATACGACTCACTATA GGGAAATAAGAGAGAAAAGAAGAGTAAGAAGAAATATAAGAG CCACC<u>ATG</u>GCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT |

TABLE 27-continued

G-CSF Constructs with miR binding sites

| SEQ ID NO. | Description | SEQ |
|---|---|---|
| | sites: G-CSF miR-142-5p | TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTAGTAGT GCTTTCTACTTTATGTGGTCTTTGAATAAAGCCTGAGTAGGAAG GCGGCCGCTCGAGCATGCATCTAGA |
| 4986 | mRNA sequence: G-CSF miR-142-5p | GGGAAAUAAGAGAGAAAAGAAGAGUAAGAAGAAAUAUAAGA GCCACC<u>AUG</u>GCCGGUCCCGCGACCCAAAGCCCCAUGAAACUU AUGGCCCUGCAGUUGCUGCUUUGGCACUCGGCCCUCUGGACA GUCCAAGAAGCGACUCCUCUCGGACCUGCCUCAUCGUUGCCG CAGUCAUUCCUUUUGAAGUGUCUGGAGCAGGUGCGAAAGAUU CAGGGCGAUGGAGCCGCACUCCAAGAGAAGCUCUGCGCGACA UACAAACUUUGCCAUCCCGAGGAGCUCGUACUGCUCGGGCAC AGCUUGGGGAUUCCCUGGGCUCCUCUCUCGUCCUGUCCGUCG CAGGCUUUGCAGUUGGCAGGGUGCCUUUCCCAGCUCCACUCC GGUUUGUUCUUGUAUCAGGGACUGCUGCAAGCCCUUGAGGGA AUCUCGCCAGAAUUGGGCCCGACGCUGGACACGUUGCAGCUC GACGUGGCGGAUUUCGCAACAACCAUCUGGCAGCAGAUGGAG GAACUGGGGAUGGCACCCGCGCUGCAGCCCACGCAGGGGGCA AUGCCGGCCUUUGCGUCCGCGUUUCAGCGCAGGGCGGGUGGA GUCCUCGUAGCGAGCCACCUUCAAUCAUUUUUGGAAGUCUCG UACCGGGUGCUGAGACAUCUUGCGCAGCCGUGAUAAUAGGCU GCCUUCUGCGGGGCUUGCCUUCUGGCCAUGCCCUUCUUCUCU CCCUUGCACCUGUACCUCUAGUAGUGCUUUCUACUUUAUGUG GUCUUUGAAUAAAGCCUGAGUAGGAAG |
| 4987 | DNA sequence having the T7 polymerase site and restriction sites: G-CSF miR-142-5p-seed | TAATACGACTCACTATA GGGAAATAAGAGAGAAAAGAAGAGTAAGAAGAAATATAAGAG CCACC<u>ATG</u>GCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCCCTTGCACCTGTACCTCTACTTTA TTGGTCTTTGAATAAAGCCTGAGTAGGAAGGCGGCCGCTCGA GCATGCATCTAGA |
| 4988 | mRNA sequence: G-CSF miR 142-5p-seed | GGGAAAUAAGAGAGAAAAGAAGAGUAAGAAGAAAUAUAAGA GCCACC <u>AUG</u>GCCGGUCCCGCGACCCAAAGCCCCAUGAAACUUAUGGCC CUGCAGUUGCUGCUUUGGCACUCGGCCCUCUGGACAGUCCAA GAAGCGACUCCUCUCGGACCUGCCUCAUCGUUGCCGCAGUCA UUCCUUUUGAAGUGUCUGGAGCAGGUGCGAAAGAUUCAGGGC GAUGGAGCCGCACUCCAAGAGAAGCUCUGCGCGACAUACAAA CUUUGCCAUCCCGAGGAGCUCGUACUGCUCGGGCACAGCUUG GGGAUUCCCUGGGCUCCUCUCUCGUCCUGUCCGUCGCAGGCU UUGCAGUUGGCAGGGUGCCUUUCCCAGCUCCACUCCGGUUUG UUCUUGUAUCAGGGACUGCUGCAAGCCCUUGAGGGAAUCUCG CCAGAAUUGGGCCCGACGCUGGACACGUUGCAGCUCGACGUG GCGGAUUUCGCAACAACCAUCUGGCAGCAGAUGGAGGAACUG GGGAUGGCACCCGCGCUGCAGCCCACGCAGGGGGCAAUGCCG GCCUUUGCGUCCGCGUUUCAGCGCAGGGCGGGUGGAGUCCUC GUAGCGAGCCACCUUCAAUCAUUUUUGGAAGUCUCGUACCGG GUGCUGAGACAUCUUGCGCAGCCG UGAUAAUAGGCUGCCUUCUGCGGGGCUUGCCUUCUGGCCAUG CCCUUCUUCUCCCUUGCACCUGUACCUCUACUUUAUUGGU CUUUGAAUAAAGCCUGAGUAGGAAG |

TABLE 27-continued

G-CSF Constructs with miR binding sites

| SEQ ID NO. | Description | SEQ |
|---|---|---|
| 4989 | DNA sequence having the T7 polymerase site and restriction sites: G-CSF miR-142-5p-seedless | TAATACGACTCACTATA GGGAAATAAGAGAGAAAAGAAGAGTAAGAAGAAATATAAGAG CCACCATGGCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTAGTAGT GCTTTCTGTGGTCTTTGAATAAAGCCTGAGTAGGAAGGCGGCC GCTCGAGCATGCATCTAGA |
| 4990 | mRNA sequence: G-CSF miR-142-5p-seedless | GGGAAAUAAGAGAGAAAAGAAGAGUAAGAAGAAAUAUAAGA GCCACC AUGGCCGGUCCCGCGACCCAAAGCCCCAUGAAACUUAUGGCC CUGCAGUUGCUGCUUUGGCACUCGGCCCUCUGGACAGUCCAA GAAGCGACUCCUCUCGGACCUGCCUCAUCGUUGCCGCAGUCA UUCCUUUUGAAGUGUCUGGAGCAGGUGCGAAAGAUUCAGGGC GAUGGAGCCGCACUCCAAGAGAAGCUCUGCGCGACAUACAAA CUUUGCCAUCCCGAGGAGCUCGUACUGCUCGGGCACAGCUUG GGGAUUCCCUGGGCUCCUCUCUCGUCCUGUCCGUCGCAGGCU UUGCAGUUGGCAGGGUGCCUUUCCCAGCUCCACUCCGGUUUG UUCUUGUAUCAGGGACUGCUGCAAGCCCUUGAGGGAAUCUCG CCAGAAUUGGGCCCGACGCUGGACACGUUGCAGCUCGACGUG GCGGAUUUCGCAACAACCAUCUGGCAGCAGAUGGAGGAACUG GGGAUGGCACCCGCGCUGCAGCCCACGCAGGGGGCAAUGCCG GCCUUUGCGUCCGCGUUUCAGCGCAGGGCGGGUGGAGUCCUC GUAGCGAGCCACCUUCAAUCAUUUUUGGAAGUCUCGUACCGG GUGCUGAGACAUCUUGCGCAGCCG UGAUAAUAGGCUGCCUUCUGCGGGGCUUGCCUUCUGGCCAUG CCCUUCUUCUCUCCCUUGCACCUGUACCUCUAGUAGUGCUUU CUGUGGUCUUUGAAUAAAGCCUGAGUAGGAAG |
| 4991 | DNA sequence having the T7 polymerase site and restriction sites: G-CSF miR-142-3p | TAATACGACTCACTATA GGGAAATAAGAGAGAAAAGAAGAGTAAGAAGAAATATAAGAG CCACCATGGCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTTCCATA AAGTAGGAAACTACATGGTCTTTGAATAAAGCCTGAGTAGG AAGGCGGCCGCTCGAGCATGCATCTAGA |
| 4992 | mRNA sequence: G-CSF miR 142-3p | GGGAAAUAAGAGAGAAAAGAAGAGUAAGAAGAAAUAUAAGA GCCACC AUGGCCGGUCCCGCGACCCAAAGCCCCAUGAAACUUAUGGCC CUGCAGUUGCUGCUUUGGCACUCGGCCCUCUGGACAGUCCAA GAAGCGACUCCUCUCGGACCUGCCUCAUCGUUGCCGCAGUCA UUCCUUUUGAAGUGUCUGGAGCAGGUGCGAAAGAUUCAGGGC GAUGGAGCCGCACUCCAAGAGAAGCUCUGCGCGACAUACAAA CUUUGCCAUCCCGAGGAGCUCGUACUGCUCGGGCACAGCUUG GGGAUUCCCUGGGCUCCUCUCUCGUCCUGUCCGUCGCAGGCU UUGCAGUUGGCAGGGUGCCUUUCCCAGCUCCACUCCGGUUUG |

TABLE 27-continued

G-CSF Constructs with miR binding sites

| SEQ ID NO. | Description | SEQ |
|---|---|---|
| | | UUCUUGUAUCAGGGACUGCUGCAAGCCCUUGAGGGAAUCUCG<br>CCAGAAUUGGGCCCGACGCUGGACACGUUGCAGCUCGACGUG<br>GCGGAUUUCGCAACAACCAUCUGGCAGCAGAUGGAGGAACUG<br>GGGAUGGCACCCGCGCUGCAGCCCACGCAGGGGGCAAUGCCG<br>GCCUUUGCGUCCGCGUUUCAGCGCAGGGCGGGUGGAGUCCUC<br>GUAGCGAGCCACCUUCAAUCAUUUUUGGAAGUCUCGUACCGG<br>GUGCUGAGACAUCUUGCGCAGCCG<br>UGAUAAUAGGCUGCCUUCUGCGGGGCUUGCCUUCUGGCCAUG<br>CCCUUCUUCUCUCCCUUGCACCUGUACCUCUUCCAUAAAGUA<br>GGAAACACUACAUGGUCUUUGAAUAAAGCCUGAGUAGGAAG |
| 4993 | DNA sequence having the T7 polymerase site and restriction sites: G-CSF miR-142-3p-seed | TAATACGACTCACTATA<br>GGGAAATAAGAGAGAAAAGAAGAGTAAGAAGAAATATAAGAG<br>CCACCATGGCCGGTCCCGCGACCCAAAGCCCCATGAAACTTAT<br>GGCCCTGCAGTTGCTGCTTTGGCACTCGGCCCTCTGGACAGTCC<br>AAGAAGCGACTCCTCTCGGACCTGCCTCATCGTTGCCGCAGTCA<br>TTCCTTTTGAAGTGTCTGGAGCAGGTGCGAAAGATTCAGGGCG<br>ATGGAGCCGCACTCCAAGAGAAGCTCTGCGCGACATACAAACT<br>TTGCCATCCCGAGGAGCTCGTACTGCTCGGGCACAGCTTGGGG<br>ATTCCCTGGGCTCCTCTCTCGTCCTGTCCGTCGCAGGCTTTGCA<br>GTTGGCAGGGTGCCTTTCCCAGCTCCACTCCGGTTTGTTCTTGT<br>ATCAGGGACTGCTGCAAGCCCTTGAGGGAATCTCGCCAGAATT<br>GGGCCCGACGCTGGACACGTTGCAGCTCGACGTGGCGGATTTC<br>GCAACAACCATCTGGCAGCAGATGGAGGAACTGGGGATGGCAC<br>CCGCGCTGCAGCCCACGCAGGGGGCAATGCCGGCCTTTGCGTC<br>CGCGTTTCAGCGCAGGGCGGGTGGAGTCCTCGTAGCGAGCCAC<br>CTTCAATCATTTTTGGAAGTCTCGTACCGGGTGCTGAGACATCT<br>TGCGCAGCCGTGATAATAGGCTGCCTTCTGCGGGGCTTGCCTTC<br>TGGCCATGCCCTTCTTCTCTCCCTTGCACCTGTACCTCTACACTA<br>CTGGTCTTTGAATAAAGCCTGAGTAGGAAGGCGGCCGCTCGA<br>GCATGCATCTAGA |
| 4994 | mRNA sequence: G-CSF miR-142-3p-seed | GGGAAAUAAGAGAGAAAAGAAGAGUAAGAAGAAAUAUAAGA<br>GCCACC<br>AUGGCCGGUCCCGCGACCCAAAGCCCCAUGAAACUUAUGGCC<br>CUGCAGUUGCUGCUUUGGCACUCGGCCCUCUGGACAGUCCA<br>GAAGCGACUCCUCUCGGACCUGCCUCAUCGUUGCCGCAGUCA<br>UUCCUUUUGAAGUGUCUGGAGCAGGUGCGAAAGAUUCAGGGC<br>GAUGGAGCCGCACUCCAAGAGAAGCUCUGCGCGACAUACAAA<br>CUUUGCCAUCCCGAGGAGCUCGUACUGCUCGGGCACAGCUUG<br>GGGAUUCCCUGGGCUCCUCUCUCGUCCUGUCCGUCGCAGGCU<br>UUGCAGUUGGCAGGGUGCCUUUCCCAGCUCCACUCCGGUUUG<br>UUCUUGUAUCAGGGACUGCUGCAAGCCCUUGAGGGAAUCUCG<br>CCAGAAUUGGGCCCGACGCUGGACACGUUGCAGCUCGACGUG<br>GCGGAUUUCGCAACAACCAUCUGGCAGCAGAUGGAGGAACUG<br>GGGAUGGCACCCGCGCUGCAGCCCACGCAGGGGGCAAUGCCG<br>GCCUUUGCGUCCGCGUUUCAGCGCAGGGCGGGUGGAGUCCUC<br>GUAGCGAGCCACCUUCAAUCAUUUUUGGAAGUCUCGUACCGG<br>GUGCUGAGACAUCUUGCGCAGCCG<br>UGAUAAUAGGCUGCCUUCUGCGGGGCUUGCCUUCUGGCCAUG<br>CCCUUCUUCUCUCCCUUGCACCUGUACCUCUACACUACUGGU<br>CUUUGAAUAAAGCCUGAGUAGGAAG |
| 4995 | DNA sequence having the T7 polymerase site and restriction sites: G-CSF miR-142-3p-seedless | TAATACGACTCACTATA<br>GGGAAATAAGAGAGAAAAGAAGAGTAAGAAGAAATATAAGAG<br>CCACCATGGCCGGTCCCGCGACCCAAAGCCCCATGAAACTTAT<br>GGCCCTGCAGTTGCTGCTTTGGCACTCGGCCCTCTGGACAGTCC<br>AAGAAGCGACTCCTCTCGGACCTGCCTCATCGTTGCCGCAGTCA<br>TTCCTTTTGAAGTGTCTGGAGCAGGTGCGAAAGATTCAGGGCG<br>ATGGAGCCGCACTCCAAGAGAAGCTCTGCGCGACATACAAACT<br>TTGCCATCCCGAGGAGCTCGTACTGCTCGGGCACAGCTTGGGG<br>ATTCCCTGGGCTCCTCTCTCGTCCTGTCCGTCGCAGGCTTTGCA<br>GTTGGCAGGGTGCCTTTCCCAGCTCCACTCCGGTTTGTTCTTGT<br>ATCAGGGACTGCTGCAAGCCCTTGAGGGAATCTCGCCAGAATT<br>GGGCCCGACGCTGGACACGTTGCAGCTCGACGTGGCGGATTTC<br>GCAACAACCATCTGGCAGCAGATGGAGGAACTGGGGATGGCAC<br>CCGCGCTGCAGCCCACGCAGGGGGCAATGCCGGCCTTTGCGTC<br>CGCGTTTCAGCGCAGGGCGGGTGGAGTCCTCGTAGCGAGCCAC<br>CTTCAATCATTTTTGGAAGTCTCGTACCGGGTGCTGAGACATCT<br>TGCGCAGCCGTGATAATAGGCTGCCTTCTGCGGGGCTTGCCTTC<br>TGGCCATGCCCTTCTTCTCTCCCTTGCACCTGTACCTCTTCCATA<br>AAGTAGGAAATGGTCTTTGAATAAAGCCTGAGTAGGAAGGCG<br>GCCGCTCGAGCATGCATCTAGA |

TABLE 27-continued

G-CSF Constructs with miR binding sites

| SEQ ID NO. | Description | SEQ |
|---|---|---|
| 4996 | mRNA sequence: G-CSF miR-142-3p-seedless | GGGAAAUAAGAGAGAAAAGAAGAGUAAGAAGAAAUAUAAGA GCCACC<u>AUG</u>GCCGGUCCCGCGACCCAAAGCCCCAUGAAACUU AUGGCCCUGCAGUUGCUGCUUUGGCACUCGGCCCUCUGGACA GUCCAAGAAGCGACUCCUCUCGGACCUGCCUCAUCGUUGCCG CAGUCAUUCCUUUUGAAGUGUCUGGAGCAGGUGCGAAAGAUU CAGGGCGAUGGAGCCGCACUCCAAGAGAAGCUCUGCGCGACA UACAAACUUUGCCAUCCCGAGGAGCUCGUACUGCUCGGGCAC AGCUUGGGGAUUCCCUGGGCUCCUCUCUCGUCCUGUCCGUCG CAGGCUUUGCAGUUGGCAGGGUGCCUUUCCCAGCUCCACUCC GGUUUGUUCUUGUAUCAGGGACUGCUGCAAGCCCUUGAGGGA AUCUCGCCAGAAUUGGGCCCGACGCUGGACACGUUGCAGCUC GACGUGGCGGAUUUCGCAACAACCAUCUGGCAGCAGAUGGAG GAACUGGGGAUGGCACCCGCGCUGCAGCCCACGCAGGGGGCA AUGCCGGCCUUUGCGUCCGCGUUUCAGCGCAGGGCGGGUGGA GUCCUCGUAGCGAGCCACCUUCAAUCAUUUUUGGAAGUCUCG UACCGGGUGCUGAGACAUCUUGCGCAGCCGUGAUAAUAGGCU GCCUUCUGCGGGGCUUGCCUUCUGGCCAUGCCCUUCUUCUCU CCCUUGCACCUGUACCUCUUCCAUAAAGUAGGAAAUGGUCUU UGAAUAAAGCCUGAGUAGGAAG |
| 4997 | DNA sequence having the T7 polymerase site and restriction sites: G-CSF miR-146a | TAATACGACTCACTATA GGGAAATAAGAGAGAAAAGAAGAGTAAGAAGAAATATAAGAG CCACC<u>ATG</u>GCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTAACCCA TGGAATTCAGTTCTCATGGTCTTTGAATAAAGCCTGAGTAGGAA GGCGGCCGCTCGAGCATGCATCTAGA |
| 4998 | mRNA sequence: G-CSF miR-146a | GGGAAAUAAGAGAGAAAAGAAGAGUAAGAAGAAAUAUAAGA GCCACC<u>AUG</u>GCCGGUCCCGCGACCCAAAGCCCCAUGAAACUU AUGGCCCUGCAGUUGCUGCUUUGGCACUCGGCCCUCUGGACA GUCCAAGAAGCGACUCCUCUCGGACCUGCCUCAUCGUUGCCG CAGUCAUUCCUUUUGAAGUGUCUGGAGCAGGUGCGAAAGAUU CAGGGCGAUGGAGCCGCACUCCAAGAGAAGCUCUGCGCGACA UACAAACUUUGCCAUCCCGAGGAGCUCGUACUGCUCGGGCAC AGCUUGGGGAUUCCCUGGGCUCCUCUCUCGUCCUGUCCGUCG CAGGCUUUGCAGUUGGCAGGGUGCCUUUCCCAGCUCCACUCC GGUUUGUUCUUGUAUCAGGGACUGCUGCAAGCCCUUGAGGGA AUCUCGCCAGAAUUGGGCCCGACGCUGGACACGUUGCAGCUC GACGUGGCGGAUUUCGCAACAACCAUCUGGCAGCAGAUGGAG GAACUGGGGAUGGCACCCGCGCUGCAGCCCACGCAGGGGGCA AUGCCGGCCUUUGCGUCCGCGUUUCAGCGCAGGGCGGGUGGA GUCCUCGUAGCGAGCCACCUUCAAUCAUUUUUGGAAGUCUCG UACCGGGUGCUGAGACAUCUUGCGCAGCCGUGAUAAUAGGCU GCCUUCUGCGGGGCUUGCCUUCUGGCCAUGCCCUUCUUCUCU CCCUUGCACCUGUACCUCUAACCCAUGGAAUUCAGUUCUCAU GGUCUUUGAAUAAAGCCUGAGUAGGAAG |
| 4999 | DNA sequence having the T7 polymerase site and restriction sites: G-CSF-146a-seed | TAATACGACTCACTATA GGGAAATAAGAGAGAAAAGAAGAGTAAGAAGAAATATAAGAG CCACC<u>ATG</u>GCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC |

TABLE 27-continued

G-CSF Constructs with miR binding sites

| SEQ ID NO. | Description | SEQ |
|---|---|---|
| | | GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTAGTTCT CTGGTCTTTGAATAAAGCCTGAGTAGGAAGGCGGCCGCTCGA GCATGCATCTAGA |
| 5000 | mRNA sequence: G-CSF- 146a-seed | GGGAAAUAAGAGAGAAAAGAAGAGUAAGAAGAAAUAUAAGA GCCACCAUGGCCGGUCCCGCGACCCAAAGCCCCAUGAAACUU AUGGCCCUGCAGUUGCUGCUUUGGCACUCGGCCCUCUGGACA GUCCAAGAAGCGACUCCUCUCGGACCUGCCUCAUCGUUGCCG CAGUCAUUCCUUUUGAAGUGUCUGGAGCAGGUGCGAAAGAUU CAGGGCGAUGGAGCCGCACUCCAAGAGAAGCUCUGCGCGACA UACAAACUUUGCCAUCCCGAGGAGCUCGUACUGCUCGGGCAC AGCUUGGGGAUUCCCUGGGCUCCUCUCUCGUCCUGUCCGUCG CAGGCUUUGCAGUUGGCAGGGUGCCUUUCCCAGCUCCACUCC GGUUUGUUCUUGUAUCAGGGACUGCUGCAAGCCCUUGAGGGA AUCUCGCCAGAAUUGGGCCCGACGCUGGACACGUUGCAGCUC GACGUGGCGGAUUUCGCAACAACCAUCUGGCAGCAGAUGGAG GAACUGGGGAUGGCACCCGCGCUGCAGCCCACGCAGGGGGCA AUGCCGGCCUUUGCGUCCGCGUUUCAGCGCAGGGCGGGUGGA GUCCUCGUAGCGAGCCACCUUCAAUCAUUUUUGGAAGUCUCG UACCGGGUGCUGAGACAUCUUGCGCAGCCGUGAUAAUAGGCU GCCUUCUGCGGGGCUUGCCUUCUGGCCAUGCCCUUCUUCUCU CCCUUGCACCUGUACCUCUAGUUCUCUGGUCUUUGAAUAAAG CCUGAGUAGGAAG |
| 5001 | DNA sequence having the T7 polymerase site and restriction sites: G-CSF- 146a- seedless | TAATACGACTCACTATA GGGAAATAAGAGAGAAAAGAAGAGTAAGAAGAAATATAAGAG CCACCATGGCCGGTCCCGCGACCCAAAGCCCCATGAAACTTAT GGCCCTGCAGTTGCTGCTTTGGCACTCGGCCCTCTGGACAGTCC AAGAAGCGACTCCTCTCGGACCTGCCTCATCGTTGCCGCAGTCA TTCCTTTTGAAGTGTCTGGAGCAGGTGCGAAAGATTCAGGGCG ATGGAGCCGCACTCCAAGAGAAGCTCTGCGCGACATACAAACT TTGCCATCCCGAGGAGCTCGTACTGCTCGGGCACAGCTTGGGG ATTCCCTGGGCTCCTCTCTCGTCCTGTCCGTCGCAGGCTTTGCA GTTGGCAGGGTGCCTTTCCCAGCTCCACTCCGGTTTGTTCTTGT ATCAGGGACTGCTGCAAGCCCTTGAGGGAATCTCGCCAGAATT GGGCCCGACGCTGGACACGTTGCAGCTCGACGTGGCGGATTTC GCAACAACCATCTGGCAGCAGATGGAGGAACTGGGGATGGCAC CCGCGCTGCAGCCCACGCAGGGGGCAATGCCGGCCTTTGCGTC CGCGTTTCAGCGCAGGGCGGGTGGAGTCCTCGTAGCGAGCCAC CTTCAATCATTTTTGGAAGTCTCGTACCGGGTGCTGAGACATCT TGCGCAGCCGTGATAATAGGCTGCCTTCTGCGGGGCTTGCCTTC TGGCCATGCCCTTCTTCTCTCCCTTGCACCTGTACCTCTAACCCA TGGAATTCATGGTCTTTGAATAAAGCCTGAGTAGGAAGGCGGC CGCTCGAGCATGCATCTAGA |
| 5002 | mRNA sequence: G-CSF- 146a- seedless | GGGAAAUAAGAGAGAAAAGAAGAGUAAGAAGAAAUAUAAGA GCCACCAUGGCCGGUCCCGCGACCCAAAGCCCCAUGAAACUU AUGGCCCUGCAGUUGCUGCUUUGGCACUCGGCCCUCUGGACA GUCCAAGAAGCGACUCCUCUCGGACCUGCCUCAUCGUUGCCG CAGUCAUUCCUUUUGAAGUGUCUGGAGCAGGUGCGAAAGAUU CAGGGCGAUGGAGCCGCACUCCAAGAGAAGCUCUGCGCGACA UACAAACUUUGCCAUCCCGAGGAGCUCGUACUGCUCGGGCAC AGCUUGGGGAUUCCCUGGGCUCCUCUCUCGUCCUGUCCGUCG CAGGCUUUGCAGUUGGCAGGGUGCCUUUCCCAGCUCCACUCC GGUUUGUUCUUGUAUCAGGGACUGCUGCAAGCCCUUGAGGGA AUCUCGCCAGAAUUGGGCCCGACGCUGGACACGUUGCAGCUC GACGUGGCGGAUUUCGCAACAACCAUCUGGCAGCAGAUGGAG GAACUGGGGAUGGCACCCGCGCUGCAGCCCACGCAGGGGGCA AUGCCGGCCUUUGCGUCCGCGUUUCAGCGCAGGGCGGGUGGA GUCCUCGUAGCGAGCCACCUUCAAUCAUUUUUGGAAGUCUCG UACCGGGUGCUGAGACAUCUUGCGCAGCCGUGAUAAUAGGCU GCCUUCUGCGGGGCUUGCCUUCUGGCCAUGCCCUUCUUCUCU CCCUUGCACCUGUACCUCUAACCCAUGGAAUUCAUGGUCUUU GAAUAAAGCCUGAGUAGGAAG |

It is like that the binding site "seed" sequence is sufficient to induce microRNA binding, the expression of G-CSF should be down-regulated in cells transfected with miR-142-3p, miR-142-3p-seed, miR-142-5p, miR-142-5p-seed, miR-146a or miR-146a-seed. Whereas, the miR-142-3p-seedless, miR-142-5p-seedless, miR-146a-seedless should not change the expression of G-CSF, as compared with cells transfected with G-CSF mRNA without microRNA binding sites.

Example 25

APCs Specific microRNA Binding Sites to Suppress Modified Nucleic Acid Mediated Immune Stimulation The binding sites for microRNAs are used in the 3'UTR of mRNA therapeutics to selectively degrade mRNA therapeutics in the immune cells to subdue unwanted immunogenic reactions caused by mRNA therapeutics delivery.

A polynucleotide comprising a series of 3'UTR miR binding sites which make the nucleic acids or mRNA of the present invention more unstable in antigen presenting cells (APCs), such as, but not limited to mir-142-5p, mir-142-3p, mir-146a-5p and mir-146a-3p, encodes an oncology-related polypeptide of the present invention. The addition of miR binding sites in the 3'UTR making a signal sensor polynucleotide unstable would subdue modified mRNA mediated immune stimulation.

Experiments comparing the cytokine expression (e.g. TNF-alpha) induced by the polypeptide with APCs specific microRNA signature vs. without such signature is performed in vitro by methods described herein and/or known in the art.

Example 26

In Vitro Expression of mRNAs with miR Binding Sites

Human embryonic kidney epithelial cells (HEK293A), antigen-presenting cells or cell lines with highly expressed mir-142/146, such as monocyte-derived dendritic cells (MDDC) or PBMC, are seeded at a density of 200,000 per well in 500 ul cell culture medium (InVitro GRO medium from Celsis, Chicago, Ill.). Cultured cells are transfected with G-CSF mRNAs with or without microRNA signature, as described in Example 24. The cells are transfected for five consecutive days. The transfection complexes are removed four hours after each round of transfection.

The culture supernatant is assayed for secreted G-CSF (R&D Systems, catalog #DCS50), tumor necrosis factor-alpha (TNF-alpha) and interferon alpha (IFN-alpha by ELISA every day after transfection following manufacturer's protocols. The cells are analyzed for viability using CELL TITER GLO® (Promega, catalog #G7570) 6 hrs and 18 hrs after the first round of transfection and every alternate day following that. At the same time from the harvested cells, total RNA is isolated and treated with DNASE®using the RNAEASY micro kit (catalog #74004) following the manufacturer's protocol. 100 ng of total RNA is used for cDNA synthesis using the High Capacity cDNA Reverse Transcription kit (Applied Biosystems, cat #4368814) following the manufacturer's protocol. The cDNA is then analyzed for the expression of innate immune response genes by quantitative real time PCR using SybrGreen in a Biorad CFX 384 instrument following the manufacturer's protocol.

Example 27

In Vivo Detection of Innate Immune Response Study

To test the nucleic acids or mRNA protein expression and in vivo immune response, female BALB/C mice (n=5) are injected intramuscularly with G-CSF mRNA with or without microRNA signatures as described in Example 24. Blood is collected at 8 hours after dosing. The protein levels of G-CSF, TNF-alpha and IFN-alpha is determined by ELISA.

The difference of cytokine production is seen as measured by mouse TNF-alpha and IFN-alpha level in serum. Injection with G-CSF modified mRNA having miR-142 and miR-146a binding site or binding site seed shows a lower level of cytokine response in vivo.

Example 28

Expression of miR-122 in Primary Hepatocytes

Hepatocyte specific miR-122 level in rat and human primary hepatocytes was measured. Hela Cells and primary rat and human hepatocytes were cultured and RNAs were extracted from cell lysates. The miR-122 level in rat and human primary hepatocytes was compared with that in Hela cells. The miR-122 level is about 6 fold increased in primary human hepatocytes and about 12 fold increased in primary rat hepatocytes, respectively, as compared with that in Hela cells.

Example 29

Expression of Modified Nucleic Acid with mir-122 Binding Site in Hepatocytes Primary rat and human hepatocytes and Hela cells were seeded at a density of 200,000 per well in 500 ul cell culture medium (InVitro GRO medium from Celsis, Chicago, Ill.). G-CSF mRNA having a miR-122 binding site in the 3'UTR (G-CSF miR-122-1X) (mRNA sequence is shown in SEQ ID NO: 4268; polyA tail of approximately 140 nucleotides not shown in sequence; 5'Cap, Cap1) fully modified with 5-methylcytidine and pseudouridine (5mC/pU), or fully modified with pseudouridine (pU) or G-CSF mRNA with four miR-122 binding sites with the seed deleted (G-CSF no seed) (mRNA sequence is shown in SEQ ID NO: 4270; polyA tail of approximately 140 nucleotides not shown in sequence; 5'Cap, Cap1) fully modified with 5-methylcytidine and pseudouridine (5mC/pU) or fully modified with pseudouridine (pU) was tested at a concentration of 250 ng per well in 24 well plates. The 24 hours after transfection, the expression of G-CSF was measured by ELISA, and the results are shown in Table 28.

TABLE 28

| | G-CSF mir122 expression | | |
|---|---|---|---|
| | Hela cells Protein Expression (ng/mL) | Primary human Hepatocytes Protein Expression (ng/mL) | Primary rat Hepatocytes Protein Expression (ng/mL) |
| G-CSF miR-122 1X (5mC/pU) | 167.34 | 67.60 | 3.40 |
| G-CSF miR-122 1X (pU) | 292.18 | 116.18 | 25.63 |

TABLE 28-continued

G-CSF mir122 expression

|  | Hela cells Protein Expression (ng/mL) | Primary human Hepatocytes Protein Expression (ng/mL) | Primary rat Hepatocytes Protein Expression (ng/mL) |
| --- | --- | --- | --- |
| G-CSF no seed (5mC/pU) | 194.78 | 129.77 | 8.39 |
| G-CSF no seed (pU) | 335.78 | 462.88 | 84.93 |

Example 30

Expression of Modified Nucleic Acids with mir-122 Binding Sites in Hepatocytes MicroRNA control gene expression through the translational suppression and/or degradation of target messenger RNA. Mir-122 binding site containing G-CSF mRNA was translationally regulated in hepatocytes.

Primary rat and human hepatocytes and Hela cells were seeded at a density of 200,000 per well in 500 ul cell culture medium (InVitro GRO medium from Celsis, Chicago, Ill.). G-CSF mRNA (G-CSF alpha) (mRNA sequence is shown in SEQ ID NO: 4266; polyA tail of approximately 140 nucleotides not shown in sequence; 5'Cap, Cap1) fully modified with 5-methylcytidine and pseudouridine (5mC/pU), G-CSF mRNA having a miR-122 binding site in the 3'UTR (G-CSF miR-122-1X) (mRNA sequence is shown in SEQ ID NO: 4268; polyA tail of approximately 140 nucleotides not shown in sequence; 5'Cap, Cap 1) fully modified with 5-methylcytidine and pseudouridine (5mc/pU) or G-CSF mRNA with four miR-122 binding sites with the seed deleted (G-CSF no seed) (mRNA sequence is shown in SEQ ID NO: 4270; polyA tail of approximately 140 nucleotides not shown in sequence; 5'Cap, Cap1) fully modified with 5-methylcytidine and pseudouridine (5mC/pU) was tested at a concentration of 250 ng per well in 24 well plates. 24 hours after transfection, the expression of G-CSF was measured by ELISA. The G-CSF drug (mRNA) levels and protein levels are shown in Table 29.

TABLE 29

G-CSF drug and protein levels

|  | Human Hepatocytes | | Rat Hepatocytes | |
| --- | --- | --- | --- | --- |
|  | Drug (mRNA) level (unit normalized to HPRT) | Protein expression (ng/ml) | Drug (mRNA) level (unit normalized to HPRT) | Protein expression (ng/ml) |
| G-CSF alpha (5mC/pU) | 43237.6 | 247.26 | 26615.88 | 784.6 |
| G-CSF miR-122-1X (5mC/pU) | 46340.9 | 74.07 | 20171.07 | 40.628 |
| G-CSF no seed (5mC/pU) | 70239.7 | 298.28 | 23170.47 | 894.06 |

Example 31

Modified mRNA Sequences with or without Kozak and/or IRES Sequences

Modified mRNA encoding G-CSF with or without a Kozak and/or IRES sequence, and their corresponding cDNA sequences, are shown below in Table 30. In Table 30, the start codon of each sequence is underlined.

TABLE 30

G-CSF Sequences

|  | Sequence | SEQ ID NO: |
| --- | --- | --- |
| G-CSF with Kozak sequence and IRES and human alpha-globin 3'UTR | Optimized G-CSF cDNA sequence containing a T7 polymerase site, kozak sequence, IRES and Xba1 restriction site:<br>TAATACGACTCACTATA<br>GGGAAATAAGAGAGAAAAGAAGAGTAAGAAGAAATATAAG<br>AGCCACC<br>TCGTGAGGATCTATTTCCGGTGAATTCCTCGAGACTAGTTCT<br>AGAGCGGCCGCGGATCCCGCCCCTCTCCCTCCCCCCCCCCTA<br>ACGTTACTGGCCGAAGCCGCTTGGAATAAGGCCGGTGTGCG<br>TTTGTCTATATGTTATTTTCCACCATATTGCCGTCTTTTGGCA<br>ATGTGAGGGCCCGGAAACCTGGCCCTGTCTTCTTGACGAGC<br>ATTCCTAGGGGTCTTTCCCCTCTCGCCAAAGGAATGCAAGGT<br>CTGTTGAATGTCGTGAAGGAAGCAGTTCCTCTGGAAGCTTCT<br>TGAAGACAAACAACGTCTGTAGCGACCCTTTGCAGGCAGCG<br>GAACCCCCCACCTGGCGACAGGTGCCTCTGCGGCCAAAAGC<br>CACGTGTATAAGATACACCTGCAAAGGCGGCACAACCCCAG<br>TGCCACGTTGTGAGTTGGATAGTTGTGGAAAGAGTCAAATG<br>GCTCACCTCAAGCGTATTCAACAAGGGCTGAAGGATGCCC<br>AGAAGGTACCCCATTGTATGGGATCTGATCTGGGCCTCGG<br>TGCACATGCTTTACATGTGTTTAGTCGAGGTTAAAAAACGTC<br>TAGGCCCCCCGAACCACGGGGACGTGGTTTTCCTTTGAAAA<br>ACACGATGATAAT<br><u>ATG</u>GCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA | 5003 |

TABLE 30-continued

G-CSF Sequences

| Sequence | SEQ ID NO: |
|---|---|
| GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCTCTAGA | |
| mRNA sequence (transcribed):<br>GGGAAAUAAGAGAGAAAAGAAGAGUAAGAAGAAAUAUAA<br>GAGCCACC<br>UCGUGAGGAUCUAUUUCCGGUGAAUUCCUCGAGACUAGUU<br>CUAGAGCGGCCGCGGAUCCCGCCCCUCUCCCUCCCCCCCCC<br>CUAACGUUACUGGCCGAAGCCGCUUGGAAUAAGGCCGGUG<br>UGCGUUUGUCUAUAUGUUAUUUUCCACCAUAUUGCCGUCU<br>UUUGGCAAUGUGAGGGCCCGGAAACCUGGCCCUGUCUUCU<br>UGACGAGCAUUCCUAGGGGUCUUUCCCCUCUCGCCAAAGG<br>AAUGCAAGGUCUGUUGAAUGUCGUGAAGGAAGCAGUUCC<br>UCUGGAAGCUUCUUGAAGACAAACAACGUCUGUAGCGACC<br>CUUUGCAGGCAGCGGAACCCCCCACCUGGCGACAGGUGCC<br>UCUGCGGCCAAAAGCCACGUGUAUAAGAUACACCUGCAAA<br>GGCGGCACAACCCCAGUGCCACGUUGUGAGUUGGAUAGUU<br>GUGGAAAGAGUCAAAUGGCUCACCUCAAGCGUAUUCAACA<br>AGGGGCUGAAGGAUGCCCAGAAGGUACCCCAUUGUAUGGG<br>AUCUGAUCUGGGGCCUCGGUGCACAUGCUUUACAUGUGUU<br>UAGUCGAGGUUAAAAAACGUCUAGGCCCCCCGAACCACGG<br>GGACGUGGUUUUCCUUUGAAAAACACGAUGAUAAU<br><u>AUG</u>GCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGC | 5004 |
| G-CSF without a Kozak sequence and with an IRES and human alpha-globin 3'UTR | Optimized G-CSF cDNA sequence containing a T7 polymerase site, IRES and Xba1 restriction site:<br>TAATACGACTCACTATA<br>GGGAAATAAGAGAGAAAAGAAGAGTAAGAAGAAATATAAGA<br>TCGTGAGGATCTATTTCCGGTGAATTCCTCGAGACTAGTTCT<br>AGAGCGGCCGCGGATCCCGCCCCTCTCCCTCCCCCCCCCTA<br>ACGTTACTGGCCGAAGCCGCTTGGAATAAGGCCGGTGTGCG<br>TTTGTCTATATGTTATTTTCCACCATATTGCCGTCTTTTGGCA<br>ATGTGAGGGCCCGGAAACCTGGCCCTGTCTTCTTGACGAGC<br>ATTCCTAGGGGTCTTTCCCCTCTCGCCAAAGGAATGCAAGGT<br>CTGTTGAATGTCGTGAAGGAAGCAGTTCCTCTGGAAGCTTCT<br>TGAAGACAAACAACGTCTGTAGCGACCCTTTGCAGGCAGCG<br>GAACCCCCCACCTGGCGACAGGTGCCTCTGCGGCCAAAAGC<br>CACGTGTATAAGATACACCTGCAAAGGCGGCACAACCCCAG<br>TGCCACGTTGTGAGTTGGATAGTTGTGGAAAGAGTCAAATG<br>GCTCACCTCAAGCGTATTCAACAAGGGGCTGAAGGATGCCC<br>AGAAGGTACCCCATTGTATGGGATCTGATCTGGGGCCTCGG<br>TGCACATGCTTTACATGTGTTTAGTCGAGGTTAAAAAACGTC<br>TAGGCCCCCCGAACCACGGGGACGTGGTTTTCCTTTGAAAA<br>ACACGATGATAAT<br><u>ATG</u>GCCGGTCCCGCGACCCAAAGCCCCATGAAACTTATGGC | 5005 |

TABLE 30-continued

G-CSF Sequences

| | Sequence | SEQ ID NO: |
|---|---|---|
| | CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA<br>GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCTCCTCCCCTTCCTGCACCCGTACCCCCGTGGT<br>CTTTGAATAAAGTCTGAGTGGGCGGCTCTAGA | |
| | mRNA sequence (transcribed):<br>GGGAAAUAAGAGAGAAAAGAAGAGUAAGAAGAAAUAUAA<br>GA<br>UCGUGAGGAUCUAUUUCCGGUGAAUUCCUCGAGACUAGUU<br>CUAGAGCGGCCGCGGAUCCCGCCCCUCUCCCUCCCCCCCCC<br>CUAACGUUACUGGCCGAAGCCGCUUGGAAUAAGGCCGGUG<br>UGCGUUUGUCUAUAUGUUAUUUUCCACCAUAUUGCCGUCU<br>UUUGGCAAUGUGAGGGCCCGGAAACCUGGCCCUGUCUUCU<br>UGACGAGCAUUCCUAGGGGUCUUUCCCCUCUCGCCAAAGG<br>AAUGCAAGGUCUGUUGAAUGUCGUGAAGGAAGCAGUUCC<br>UCUGGAAGCUUCUUGAAGACAAACAACGUCUGUAGCGACC<br>CUUUGCAGGCAGCGGAACCCCCCACCUGGCGACAGGUGCC<br>UCUGCGGCCAAAAGCCACGUGUAUAAGAUACACCUGCAAA<br>GGCGGCACAACCCCAGUGCCACGUUGUGAGUUGGAUAGUU<br>GUGGAAAGAGUCAAAUGGCUCACCUCAAGCGUAUUCAACA<br>AGGGGCUGAAGGAUGCCCAGAAGGUACCCCAUUGUAUGGG<br>AUCUGAUCUGGGGCCUCGGUGCACAUGCUUUACAUGUGUU<br>UAGUCGAGGUUAAAAAACGUCUAGGCCCCCCGAACCACGG<br>GGACGUGGUUUUCCUUUGAAAAACACGAUGAUAAU<br><u>AUG</u>GCCGGUCCCGCGACCCAAAGCCCCAUGAAACUUAUGG<br>CCCUGCAGUUGCUGCUUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGC | 5006 |
| G-CSF without a Kozak sequence and with a human alpha-globin 3'UTR | Optimized G-CSF cDNA sequence containing a T7 polymerase site, a Kozak sequence and Xba1 restriction site:<br>TAATACGACTCACTATA<br>GGGAAATAAGAGAGAAAAGAAGAGTAAGAAGAAATATAAGA<br><u>ATG</u>GCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA<br>GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG | 5007 |

TABLE 30-continued

G-CSF Sequences

| | Sequence | SEQ ID NO: |
|---|---|---|
| | GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCTCTAGA | |
| | mRNA sequence (transcribed):<br>GGGAAAUAAGAGAGAAAAGAAGAGUAAGAAGAAAUAUAA<br>GA<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGC | 5008 |
| G-CSF with an IRES, a human alpha-globin 3'UTR and a polyA tail of 80 nucleotides | Optimized G-CSF cDNA sequence containing a T7 polymerase site, IRES, a polyA tail of 80 nucleotides and Asc1 restriction site:<br>TAATACGACTCACTATA<br>GGGAAATAAGAGAGAAAAGAAGAGTAAGAAGAAATATAAG<br>AGCCACC<br>TCGTGAGGATCTATTTCCGGTGAATTCCTCGAGACTAGTTCT<br>AGAGCGGCCGCGGATCCCGCCCCTCTCCCTCCCCCCCCCCTA<br>ACGTTACTGGCCGAAGCCGCTTGGAATAAGGCCGGTGTGCG<br>TTTGTCTATATGTTATTTTCCACCATATTGCCGTCTTTTGGCA<br>ATGTGAGGGCCCGGAAACCTGGCCCTGTCTTCTTGACGAGC<br>ATTCCTAGGGGTCTTTCCCCTCTCGCCAAAGGAATGCAAGGT<br>CTGTTGAATGTCGTGAAGGAAGCAGTTCCTCTGGAAGCTTCT<br>TGAAGACAAACAACGTCTGTAGCGACCCTTTGCAGGCAGCG<br>GAACCCCCCACCTGGCGACAGGTGCCTCTGCGGCCAAAAGC<br>CACGTGTATAAGATACACCTGCAAAGGCGGCACAACCCCAG<br>TGCCACGTTGTGAGTTGGATAGTTGTGGAAAGAGTCAAATG<br>GCTCACCTCAAGCGTATTCAACAAGGGGCTGAAGGATGCCC<br>AGAAGGTACCCCATTGTATGGGATCTGATCTGGGGCCTCGG<br>TGCACATGCTTTACATGTGTTTAGTCGAGGTTAAAAAACGTC<br>TAGGCCCCCCGAACCACGGGGACGTGGTTTTCCTTTGAAAA<br>ACACGATGATAAT<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA<br>GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCAAAAAAAAAAAAAAA | 5009 |

TABLE 30-continued

G-CSF Sequences

| Sequence | SEQ ID NO: |
|---|---|
| AAAAAAAAAAAAAAAAAAAAAAAAAAAAAAAAAAAA<br>AAAAAAAAAAAAAAAAAAAAAAAAAAGGCGCGCC | |
| mRNA sequence (transcribed):<br>GGGAAAUAAGAGAGAAAAGAAGAGUAAGAAGAAAUAUAA<br>GAGCCACC<br>UCGUGAGGAUCUAUUUCCGGUGAAUUCCUCGAGACUAGUU<br>CUAGAGCGGCCGCGGAUCCCGCCCCUCUCCCUCCCCCCCCC<br>CUAACGUUACUGGCCGAAGCCGCUUGGAAUAAGGCCGGUG<br>UGCGUUUGUCUAUAUGUUAUUUUCCACCAUAUUGCCGUCU<br>UUUGGCAAUGUGAGGGCCCGGAAACCUGGCCCUGUCUUCU<br>UGACGAGCAUUCCUAGGGGUCUUUCCCCUCUCGCCAAAGG<br>AAUGCAAGGUCUGUUGAUGUCGUGAAGGAAGCAGUUCC<br>UCUGGAAGCUUCUUGAAGACAAACAACGUCUGUAGCGACC<br>CUUUGCAGGCAGCGGAACCCCCCACCUGGCGACAGGUGCC<br>UCUGCGGCCAAAAGCCACGUGUAUAAGAUACACCUGCAAA<br>GGCGGCACAACCCCAGUGCCACGUUGUGAGUUGGAUAGUU<br>GUGGAAAGAGUCAAAUGGCUCACCUCAAGCGUAUUCAACA<br>AGGGGCUGAAGGAUGCCCAGAAGGUACCCCAUUGUAUGGG<br>AUCUGAUCUGGGGCCUCGGUGCACAUGCUUUACAUGUGUU<br>UAGUCGAGGUUAAAAAACGUCUAGGCCCCCCGAACCACGG<br>GGACGUGGUUUUCCUUUGAAAAACACGAUGAUAAU<br>AUGGCCGGUCCCGCGACCCAAAGCCCCAUGAAACUUAUGG<br>CCCUGCAGUUGCUGCUUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGC<br>AAAAAAAAAAAAAAAAAAAAAAAAAAAAAAAAAAAA<br>AAAAAAAAAAAAAAAAAAAAAAAAAAAAAAAAAAAA<br>AA | 5010 |
| G-CSF without a Kozak sequence and with an IRES, a human alpha-globin 3'UTR and a polyA tail of 80 nucleotides | Optimized G-CSF cDNA sequence containing a T7 polymerase site, an IRES sequence, a polyA tail of 80 nucleotides and Asc1 restriction site:<br>TAATACGACTCACTATA<br>GGGAAATAAGAGAGAAAAGAAGAGTAAGAAGAAATATAAGA<br>TCGTGAGGATCTATTTCCGGTGAATTCCTCGAGACTAGTTCT<br>AGAGCGGCCGCGGATCCCGCCCCTCTCCCTCCCCCCCCCTA<br>ACGTTACTGGCCGAAGCCGCTTGGAATAAGGCCGGTGTGCG<br>TTTGTCTATATGTTATTTTCCACCATATTGCCGTCTTTTGGCA<br>ATGTGAGGGCCCGGAAACCTGGCCCTGTCTTCTTGACGAGC<br>ATTCCTAGGGGTCTTTCCCCTCTCGCCAAAGGAATGCAAGGT<br>CTGTTGAATGTCGTGAAGGAAGCAGTTCCTCTGGAAGCTTCT<br>TGAAGACAAACAACGTCTGTAGCGACCCTTTGCAGGCAGCG<br>GAACCCCCCACCTGGCGACAGGTGCCTCTGCGGCCAAAAGC<br>CACGTGTATAAGATACACCTGCAAAGGCGGCACAACCCCAG<br>TGCCACGTTGTGAGTTGGATAGTTGTGGAAAGAGTCAAATG<br>GCTCACCTCAAGCGTATTCAACAAGGGGCTGAAGGATGCCC<br>AGAAGGTACCCCATTGTATGGGATCTGATCTGGGGCCTCGG<br>TGCACATGCTTTACATGTGTTTAGTCGAGGTTAAAAAACGTC<br>TAGGCCCCCCGAACCACGGGGACGTGGTTTTCCTTTGAAAA<br>ACACGATGATAAT<br>ATGGCCGGTCCCGCGACCCAAAGCCCCATGAAACTTATGGC<br>CCTGCAGTTGCTGCTTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA | 5011 |

TABLE 30-continued

G-CSF Sequences

| Sequence | SEQ ID NO: |
|---|---|
| GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCAAAAAAAAAAAAAA<br>AAAAAAAAAAAAAAAAAAAAAAAAAAAAAAAAAAAAAA<br>AAAAAAAAAAAAAAAAAAAAAAAAAAGGCGCGCC | |
| mRNA sequence (transcribed):<br>GGGAAAUAAGAGAGAAAAGAAGAGUAAGAAGAAAUAUAA<br>GA<br>UCGUGAGGAUCUAUUUCCGGUGAAUUCCUCGAGACUAGUU<br>CUAGAGCGGCCGCGGAUCCCGCCCCUCUCCCUCCCCCCCCC<br>CUAACGUUACUGGCCGAAGCCGUUGGAAUAAGGCCGGUG<br>UGCGUUUGUCUAUAUGUUAUUUUCCACCAUAUUGCCGUCU<br>UUUGGCAAUGUGAGGGCCCGGAAACCUGGCCCUGUCUUCU<br>UGACGAGCAUUCCUAGGGGUCUUUCCCCUCUCGCCAAAGG<br>AAUGCAAGGUCUGUUGAAUGUCGUGAAGGAAGCAGUUCC<br>UCUGGAAGCUUCUUGAAGACAAACAACGUCUGUAGCGACC<br>CUUUGCAGGCAGCGGAACCCCCCACCUGGCGACAGGUGCC<br>UCUGCGGCCAAAAGCCACGUGUAUAAGAUACACCUGCAAA<br>GGCGGCACAACCCCAGUGCCACGUUGUGAGUUGGAUAGUU<br>GUGGAAAGAGUCAAAUGGCUCACCUCAAGCGUAUUCAACA<br>AGGGGCUGAAGGAUGCCCAGAAGGUACCCCAUUGUAUGGG<br>AUCUGAUCUGGGGCCUCGGUGCACAUGCUUUACAUGUGUU<br>UAGUCGAGGUUAAAAAACGUCUAGGCCCCCCGAACCACGG<br>GGACGUGGUUUUCCUUUGAAAAACACGAUGAUAAU<br>AUGGCCGGUCCCGCGACCCAAAGCCCCAUGAAACUUAUGG<br>CCCUGCAGUUGCUGCUUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGCAAAAAAAAAA<br>AAAAAAAAAAAAAAAAAAAAAAAAAAAAAAAAAAAAAA<br>AAAAAAAAAAAAAAAAAAAAAAAAAAA | 5012 |
| G-CSF with a human alpha-globin 3'UTR and a polyA tail of 80 nucleotides    Optimized G-CSF cDNA sequence containing a T7 polymerase site, a polyA tail of 80 nucleotides and Asc1 restriction site:<br>TAATACGACTCACTATA<br>GGGAAATAAGAGAGAAAAGAAGAGTAAGAAGAAATATAAG<br>AGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA<br>GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG | 5013 |

TABLE 30-continued

G-CSF Sequences

| Sequence | SEQ ID NO: |
|---|---|
| CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCAAAAAAAAAAAAAA<br>AAAAAAAAAAAAAAAAAAAAAAAAAAAAAAAAAAAA<br>AAAAAAAAAAAAAAAAAAAAAAAAAGGCGCGCC | |
| mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGCAAAAAAAAAA<br>AAAAAAAAAAAAAAAAAAAAAAAAAAAAAAAAAAA<br>AAAAAAAAAAAAAAAAAAAAAAAAAAAAA | 5014 |
| G-CSF without a kozak sequence and with a human alpha-globin 3'UTR and a polyA tail of 80 nucleotides | Optimized G-CSF cDNA sequence containing a T7 polymerase site, a polyA tail of 80 nucleotides and Asc1 restriction site:<br>TAATACGACTCACTATA<br>GGGAAATAAGAGAGAAAAGAAGAGTAAGAAGAAATATAAGA<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGTC<br>ATTCCTTTTGAAGTGTCTGGAGCAGGTGCGAAAGATTCAGG<br>GCGATGGAGCCGCACTCCAAGAGAAGCTCTGCGCGACATAC<br>AAACTTTGCCATCCCGAGGAGCTCGTACTGCTCGGGCACAG<br>CTTGGGGATTCCCTGGGCTCCTCTCTCGTCCTGTCCGTCGCA<br>GGCTTTGCAGTTGGCAGGGTGCCTTTCCCAGCTCCACTCCGG<br>TTTGTTCTTGTATCAGGGACTGCTGCAAGCCCTTGAGGGAAT<br>CTCGCCAGAATTGGGCCCGACGCTGGACACGTTGCAGCTCG<br>ACGTGGCGGATTTCGCAACAACCATCTGGCAGCAGATGGAG<br>GAACTGGGGATGGCACCCGCGCTGCAGCCCACGCAGGGGG<br>CAATGCCGGCCTTTGCGTCCGCGTTTCAGCGCAGGGCGGGT<br>GGAGTCCTCGTAGCGAGCCACCTTCAATCATTTTTGGAAGTC<br>TCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCGTGGT<br>CTTTGAATAAAGTCTGAGTGGGCGGCAAAAAAAAAAAAAA<br>AAAAAAAAAAAAAAAAAAAAAAAAAAAAAAAAAAAA<br>AAAAAAAAAAAAAAAAAAAAAAAAAGGCGCGCC | 5015 |
| | mRNA sequence (transcribed):<br>GGGAAAUAAGAGAGAAAAGAAGAGUAAGAAGAAAUAUAA<br>GA<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA | 5016 |

TABLE 30-continued

G-CSF Sequences

| Sequence | SEQ ID NO: |
|---|---|
| AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGACA<br>UCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCGU<br>GGUCUUUGAAUAAAGUCUGAGUGGGCGGCAAAAAAAAAA<br>AAAAAAAAAAAAAAAAAAAAAAAAAAAAAAAAAAAAAAAA<br>AAAAAAAAAAAAAAAAAAAAAAAAAAAAAAA | |

These modified mRNA sequences can include at least one chemical modification described herein. The G-CSF modified mRNA sequence can be formulated, using methods described herein and/or known in the art, prior to transfection and/or administration.

The modified mRNA sequence encoding G-CSF can be transfected in vitro to various cell types such as HEK293, HeLa, PBMC and BJ fibroblast and those described in Table 25 using methods disclosed herein and/or are known in the art. The cells are then analyzed using methods disclosed herein and/or are known in the art to determine the concentration of G-CSF and/or cell viability.

The modified mRNA sequence encoding G-CSF can also be administered to mammals including mat, rats, non-human primates and humans. The serum and surrounding tissue can be collected at pre-determined intervals and analyzed using methods disclosed herein and/or are known in the art to determine the concentration of G-CSF and other pharmacokinetic properties mentioned herein.

Example 32

Modified mRNA Sequences miR-122 Sequences in an Alpha-Globin UTR

Modified mRNA encoding G-CSF or Factor IX with a mir-122 sequence in a human or mouse alpha-globin 3'UTR, and their corresponding cDNA sequences, are shown below in Table 31. In Table 31, the start codon of each sequence is underlined.

TABLE 31

G-CSF and FIX Sequences

| Description | Sequence | SEQ ID NO: |
|---|---|---|
| G-CSF with 1 miR-122 sequence in human alpha-globin 3'UTR | Optimized G-CSF cDNA sequence containing a T7 polymerase site and Xba1 restriction site:<br>TAATACGACTCACTATA<br>GGGAAATAAGAGAGAAAAGAAGAGTAAGAAGAAATATAA<br>GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCAAAC<br>ACCATTGTCACACTCCAGTGGTCTTTGAATAAAGTCTGAGTG<br>GGCGGCTCTAGA | 5017 |
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG | 5018 |

TABLE 31-continued

G-CSF and FIX Sequences

| Description | Sequence | SEQ ID NO: |
|---|---|---|
| | CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGGAGCCUCGGUGGCCAUGCUUCUUGCCCCUUGGGCCU<br>CCCCCCAGCCCUCCUCCCCUUCCUGCACCCGUACCCCCCA<br>AACACCAUUGUCACACUCCAGUGGUCUUUGAAUAAAGUCU<br>GAGUGGGCGGC | |
| G-CSF with 1 miR-122 seed sequence in human alpha globin 3'UTR | Optimized G-CSF cDNA sequence containing a T7 polymerase site and XbaI restriction site:<br>TAATACGACTCACTATA<br>GGGAAATAAGAGAGAAAAGAAGAGTAAGAAGAAATATAA<br>GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCACACT<br>CCGTGGTCTTTGAATAAAGTCTGAGTGGGCGGCTCTAGA | 5019 |
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGGAGCCUCGGUGGCCAUGCUUCUUGCCCCUUGGGCCU<br>CCCCCCAGCCCUCCUCCCCUUCCUGCACCCGUACCCCCAC<br>ACUCCGUGGUCUUUGAAUAAAGUCUGAGUGGGCGGC | 5020 |
| G-CSF with 1 miR-122 sequence without the | Optimized G-CSF cDNA sequence containing a T7 polymerase site and XbaI restriction site:<br>TAATACGACTCACTATA<br>GGGAAATAAGAGAGAAAAGAAGAGTAAGAAGAAATATAA | 5021 |

TABLE 31-continued

G-CSF and FIX Sequences

| Description | Sequence | SEQ ID NO: |
|---|---|---|
| seed in human alpha-globin 3'UTR | GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCCAAAC<br>ACCATTGTCAGTGGTCTTTGAATAAAGTCTGAGTGGGCGGC<br>TCTAGA | |
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCCA<br>AACACCAUUGUCAGUGGUCUUUGAAUAAAGUCUGAGUGG<br>GCGGC | 5022 |
| G-CSF with 1 miR-122 sequence in mouse alpha-globin 3'UTR | Optimized G-CSF cDNA sequence containing a T7 polymerase site and XbaI restriction site:<br>TAATACGACTCACTATA<br>GGGAAATAAGAGAGAAAAGAAGAGTAAGAAGAAATATAA<br>GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGCCTTCTGCGGGCTTGCCTTCTGGCCATGCCCTTCTTC<br>TCTCCCTTGCACCTGTACCTCTCAAACACCATTGTCACACTC<br>CATGGTCTTTGAATAAAGCCTGAGTAGGAAGGCGGCCGCTC<br>GAGCATGCATCTAGA | 5023 |

TABLE 31-continued

G-CSF and FIX Sequences

| Description | Sequence | SEQ ID NO: |
|---|---|---|
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGCCUUCUGCGGGGCUUGCCUUCUGGCCAUGCCCUUCU<br>UCUCUCCCUUGCACCUGUACCUCUCAAACACCAUUGUCAC<br>ACUCCAUGGUCUUUGAAUAAAGCCUGAGUAGGAAG | 5024 |
| G-CSF with 1 miR-122 seed sequence in mouse alpha-globin 3'UTR | Optimized G-CSF cDNA sequence containing a T7 polymerase site and Xba1 restriction site:<br>TAATACGACTCACTATA<br>GGGAATAAGAGAGAAAAGAAGAGTAAGAAGAAATATAA<br>GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGCCTTCTGCGGGGCTTGCCTTCTGGCCATGCCCTTCTTC<br>TCTCCCTTGCACCTGTACCTCTACACTCCTGGTCTTTGAATA<br>AAGCCTGAGTAGGAAGGCGGCCGCTCGAGCATGCATCTAGA | 5025 |
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGCCUUCUGCGGGGCUUGCCUUCUGGCCAUGCCCUUCU<br>UCUCUCCCUUGCACCUGUACCUCUACACUCCUGGUCUUUG<br>AAUAAAGCCUGAGUAGGAAG | 5026 |

TABLE 31-continued

G-CSF and FIX Sequences

| Description | Sequence | SEQ ID NO: |
|---|---|---|
| G-CSF with 1 miR-122 sequence without the seed in mouse alpha-globin 3'UTR | Optimized G-CSF cDNA sequence containing a T7 polymerase site and Xba1 restriction site:<br>TAATACGACTCACTATA<br>GGGAAATAAGAGAGAAAAGAAGAGTAAGAAGAAATATAA<br>GAGCCACC<br>ATGGCCGGTCCCGCGACCCAAAGCCCCATGAAACTTATGGC<br>CCTGCAGTTGCTGCTTTGGCACTCGGCCCTCTGGACAGTCCA<br>AGAAGCGACTCCTCTCGGACCTGCCTCATCGTTGCCGCAGT<br>CATTCCTTTTGAAGTGTCTGGAGCAGGTGCGAAAGATTCAG<br>GGCGATGGAGCCGCACTCCAAGAGAAGCTCTGCGCGACATA<br>CAAACTTTGCCATCCCGAGGAGCTCGTACTGCTCGGGCACA<br>GCTTGGGGATTCCCTGGGCTCCTCTCTCGTCCTGTCCGTCGC<br>AGGCTTTGCAGTTGGCAGGGTGCCTTTCCCAGCTCCACTCCG<br>GTTTGTTCTTGTATCAGGGACTGCTGCAAGCCCTTGAGGGA<br>ATCTCGCCAGAATTGGGCCCGACGCTGGACACGTTGCAGCT<br>CGACGTGGCGGATTTCGCAACAACCATCTGGCAGCAGATGG<br>AGGAACTGGGGATGGCACCCGCGCTGCAGCCCACGCAGGG<br>GGCAATGCCGGCCTTTGCGTCCGCGTTTCAGCGCAGGGCGG<br>GTGGAGTCCTCGTAGCGAGCCACCTTCAATCATTTTTGGAA<br>GTCTCGTACCGGGTGCTGAGACATCTTGCGCAGCCG<br>TGATAATAG<br>GCTGCCTTCTGCGGGCTTGCCTTCTGGCCATGCCCTTCTTC<br>TCTCCCTTGCACCTGTACCTCTCAAACACCATTGTCATGGTC<br>TTTGAATAAAGCCTGAGTAGGAAGGCGGCCGCTCGAGCATG<br>CATCTAGA | 5027 |
| | mRNA sequence (transcribed):<br>GGGAAAUAAGAGAGAAAAGAAGAGUAAGAAGAAAUAUAA<br>GAGCCACC<br>AUGGCCGGUCCCGCGACCCAAAGCCCCAUGAAACUUAUGG<br>CCCUGCAGUUGCUGCUUUGGCACUCGGCCCUCUGGACAGU<br>CCAAGAAGCGACUCCUCUCGGACCUGCCUCAUCGUUGCCG<br>CAGUCAUUCCUUUUGAAGUGUCUGGAGCAGGUGCGAAAG<br>AUUCAGGGCGAUGGAGCCGCACUCCAAGAGAAGCUCUGCG<br>CGACAUACAAACUUUGCCAUCCCGAGGAGCUCGUACUGCU<br>CGGGCACAGCUUGGGGAUUCCCUGGGCUCCUCUCUCGUCC<br>UGUCCGUCGCAGGCUUUGCAGUUGGCAGGGUGCCUUUCCC<br>AGCUCCACUCCGGUUUGUUCUUGUAUCAGGGACUGCUGCA<br>AGCCCUUGAGGGAAUCUCGCCAGAAUUGGGCCCGACGCUG<br>GACACGUUGCAGCUCGACGUGGCGGAUUUCGCAACAACCA<br>UCUGGCAGCAGAUGGAGGAACUGGGGAUGGCACCCGCGCU<br>GCAGCCCACGCAGGGGGCAAUGCCGGCCUUUGCGUCCGCG<br>UUUCAGCGCAGGGCGGGUGGAGUCCUCGUAGCGAGCCACC<br>UUCAAUCAUUUUUGGAAGUCUCGUACCGGGUGCUGAGAC<br>AUCUUGCGCAGCCG<br>UGAUAAUAG<br>GCUGCCUUCUGCGGGCUUGCCUUCUGGCCAUGCCCUUCU<br>UCUCUCCCUUGCACCUGUACCUCUCAAACACCAUUGUCAU<br>GGUCUUUGAAUAAAGCCUGAGUAGGAAG | 5028 |
| Factor IX with 1 miR-122 sequence in human alpha-globin 3'UTR | Optimized Factor IX cDNA sequence containing a T7 polymerase site and Xba1 restriction site:<br>TAATACGACTCACTATA<br>GGGAAATAAGAGAGAAAAGAAGAGTAAGAAGAAATATAA<br>GAGCCACC<br>ATGCAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT<br>GTGCAGGGCAATCTTGAACAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAGTCGATGCTTTTGTGGAGGTTCCATTGTCAACGAG | 5029 |

TABLE 31-continued

G-CSF and FIX Sequences

| Description | Sequence | SEQ ID NO: |
|---|---|---|
| | AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT<br>CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCCAAAC<br>ACCATTGTCACACTCCAGTGGTCTTTGAATAAAGTCTGAGTG<br>GGCGGCTCTAGA | |
| | mRNA sequence (transcribed):<br>GGGAAAUAAGAGAGAAAAGAAGAGUAAGAAGAAAUAUAA<br>GAGCCACC<br>AUGCAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA<br>GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA<br>CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCCA<br>AACACCAUUGUCACACUCCAGUGGUCUUUGAAUAAAGUCU<br>GAGUGGGCGGC | 5030 |
| Factor IX<br>with 1 miR-<br>122 seed<br>sequence in<br>human<br>alpha-globin<br>3'UTR | Optimized Factor IX cDNA sequence containing a T7 polymerase site<br>and XbaI restriction site:<br>TAATACGACTCACTATA<br>GGGAAATAAGAGAGAAAAGAAGAGTAAGAAGAAATATAA<br>GAGCCACC<br>ATGCAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT | 5031 |

TABLE 31-continued

G-CSF and FIX Sequences

| Description | Sequence | SEQ ID NO: |
|---|---|---|
| | GTGCAGGGCAATCTTGAACGAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAAGTCGATGCCTTTTGTGGAGGTTCCATTGTCAACGAG<br>AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT<br>CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCACACT<br>CCGTGGTCTTTGAATAAAGTCTGAGTGGGCGGCTCTAGA | |
| mRNA sequence (transcribed):<br>GGGAAAUAAGAGAGAAAAGAAGAGUAAGAAGAAAUAUAA<br>GAGCCACC<br>AUGCAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA<br>GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA<br>CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG | 5032 |

TABLE 31-continued

G-CSF and FIX Sequences

| Description | Sequence | SEQ ID NO: |
|---|---|---|
| | GCUGGAGCCUCGGUGGCCAUGCUUCUUGCCCCUUGGGCCU<br>CCCCCCAGCCCCUCCUCCCCUUCCUGCACCCGUACCCCCAC<br>ACUCCGUGGUCUUUGAAUAAAGUCUGAGUGGGCGGC | |
| Factor IX with 1 miR-122 sequence without the seed in human alpha-globin 3'UTR | Optimized Factor IX cDNA sequence containing a T7 polymerase site and XbaI restriction site:<br>TAATACGACTCACTATA<br>GGGAAATAAGAGAGAAAAGAAGAGTAAGAAGAAATATAA<br>GAGCCACC<br>ATGCAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT<br>GTGCAGGGCAATCTTGAACGAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAAGTCGATGCCTTTTGTGGAGGTTCCATTGTCAACGAG<br>AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT<br>CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGGAGCCTCGGTGGCCATGCTTCTTGCCCCTTGGGCCTCC<br>CCCCAGCCCCTCCTCCCCTTCCTGCACCCGTACCCCCAAAC<br>ACCATTGTCAGTGGTCTTTGAATAAAGTCTGAGTGGGCGGC<br>TCTAGA | 5033 |
| | mRNA sequence (transcribed):<br>GGGAAAUAAGAGAGAAAAGAAGAGUAAGAAGAAAUAUAA<br>GAGCCACC<br>AUGCAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA<br>GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA | 5034 |

TABLE 31-continued

G-CSF and FIX Sequences

| Description | Sequence | SEQ ID NO: |
|---|---|---|
| | CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG<br>GCUGGAGCCUCGGUGGCCAUGCUUCUUGCCCCUUGGGCCU<br>CCCCCCAGCCCCUCCUCCCCUUCCUGCACCCGUACCCCCCA<br>AACACCAUUGUCAGUGGUCUUUGAAUAAAGUCUGAGUGG<br>GCGGC | |
| Factor IX with 1 miR-122 sequence in mouse alpha-globin 3'UTR | Optimized Factor IX cDNA sequence containing a T7 polymerase site and XbaI restriction site:<br>TAATACGACTCACTATA<br>GGGAAATAAGAGAGAAAAGAAGAGTAAGAAGAAATATAA<br>GAGCCACC<br>ATGCAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT<br>GTGCAGGGCAATCTTGAACGAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAAGTCGATGCCTTTTGTGGAGGTTCCATTGTCAACGAG<br>AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT<br>CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGCCTTCTGCGGGGCTTGCCTTCTGGCCATGCCCTTCTTC<br>TCTCCCTTGCACCTGTACCTCTCAAACACCATTGTCACACTC<br>CATGGTCTTTGAATAAAGCCTGAGTAGGAAGGCGGCCGCTC<br>GAGCATGCATCTAGA | 5035 |
| | mRNA sequence (transcribed):<br>GGGAAAUAAGAGAGAAAAGAAGAGUAAGAAGAAAUAUAA<br>GAGCCACC<br>AUGCAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA | 5036 |

TABLE 31-continued

G-CSF and FIX Sequences

| Description | Sequence | SEQ ID NO: |
|---|---|---|
| | GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA<br>CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG<br>GCUGCCUUCUGCGGGCUUGCCUUCUGGCCAUGCCCUUCU<br>UCUCUCCCUUGCACCUGUACCUCUCAAACACCAUUGUCAC<br>ACUCCAUGGUCUUUGAAUAAAGCCUGAGUAGGAAG | |
| Factor IX with 1 miR-122 seed sequence in mouse alpha-globin 3'UTR | Optimized Factor IX cDNA sequence containing a T7 polymerase site and Xba1 restriction site:<br>TAATACGACTCACTATA<br>GGGAAATAAGAGAGAAAAGAAGAGTAAGAAGAAATATAA<br>GAGCCACC<br>ATGCAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT<br>GTGCAGGGCAATCTTGAACGAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAAGTCGATGCCTTTTGTGGAGGTTCCATTGTCAACGAG<br>AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT<br>CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGCCTTCTGCGGGCTTGCCTTCTGGCCATGCCCTTCTTC | 5037 |

TABLE 31-continued

G-CSF and FIX Sequences

| Description | Sequence | SEQ ID NO: |
|---|---|---|
| | TCTCCCTTGCACCTGTACCTCTACACTCCTGGTCTTTGAATA<br>AAGCCTGAGTAGGAAGGCGGCCGCTCGAGCATGCATCTAGA | |
| | mRNA sequence (transcribed):<br>GGGAAAUAAGAGAGAAAAGAAGAGUAAGAAGAAAUAUAA<br>GAGCCACC<br><u>AUG</u>CAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA<br>GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA<br>CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG<br>GCUGCCUUCUGCGGGGCUUGCCUUCUGGCCAUGCCCUUCU<br>UCUCUCCCUUGCACCUGUACCUCUACACUCCUGGUCUUUG<br>AAUAAAGCCUGAGUAGGAAG | 5038 |
| Factor IX with 1 miR-122 sequence without the seed in mouse alpha-globin 3'UTR | Optimized Factor IX cDNA sequence containing a T7 polymerase site and Xba1 restriction site:<br>TAATACGACTCACTATA<br>GGGAAATAAGAGAGAAAAGAAGAGTAAGAAGAAATATAA<br>GAGCCACC<br><u>ATG</u>CAGCGCGTCAACATGATTATGGCCGAATCGCCGGGACT<br>CATCACAATCTGCCTCTTGGGTTATCTCTTGTCGGCAGAATG<br>TACCGTGTTCTTGGATCACGAAAACGCGAACAAAATTCTTA<br>ATCGCCCGAAGCGGTATAACTCCGGGAAACTTGAGGAGTTT<br>GTGCAGGGCAATCTTGAACGAGAGTGCATGGAGGAGAAAT<br>GCTCCTTTGAGGAGGCGAGGGAAGTGTTTGAAAACACAGAG<br>CGAACAACGGAGTTTTGGAAGCAATACGTAGATGGGGACC<br>AGTGTGAGTCGAATCCGTGCCTCAATGGGGGATCATGTAAA<br>GATGACATCAATAGCTATGAATGCTGGTGCCCGTTTGGGTTT<br>GAAGGGAAGAACTGTGAGCTGGATGTGACGTGCAACATCA<br>AAAACGGACGCTGTGAGCAGTTTTGTAAGAACTCGGCTGAC<br>AATAAGGTAGTATGCTCGTGCACAGAGGGATACCGGCTGGC<br>GGAGAACCAAAAATCGTGCGAGCCCGCAGTCCCGTTCCCTT<br>GTGGGAGGGTGAGCGTGTCACAGACTAGCAAGTTGACGAG<br>AGCGGAGACTGTATTCCCCGACGTGGACTACGTCAACAGCA<br>CCGAAGCCGAAACAATCCTCGATAACATCACGCAGAGCACT<br>CAGTCCTTCAATGACTTTACGAGGGTCGTAGGTGGTGAGGA<br>CGCGAAACCCGGTCAGTTCCCCTGGCAGGTGGTATTGAACG<br>GAAAAGTCGATGCCTTTTGTGGAGGTTCCATTGTCAACGAG<br>AAGTGGATTGTCACAGCGGCACACTGCGTAGAAACAGGAGT<br>GAAAATCACGGTAGTGGCGGGAGAGCATAACATTGAAGAG<br>ACAGAGCACACGGAACAAAAGCGAAATGTCATCAGAATCA<br>TTCCACACCATAACTATAACGCGGCAATCAATAAGTACAAT | 5039 |

TABLE 31-continued

G-CSF and FIX Sequences

| Description | Sequence | SEQ ID NO: |
|---|---|---|
| | CACGACATCGCACTTTTGGAGCTTGACGAACCTTTGGTGCTT<br>AATTCGTACGTCACCCCTATTTGTATTGCCGACAAAGAGTAT<br>ACAAACATCTTCTTGAAATTCGGCTCCGGGTACGTATCGGG<br>CTGGGGCAGAGTGTTCCATAAGGGTAGATCCGCACTGGTGT<br>TGCAATACCTCAGGGTGCCCCTCGTGGATCGAGCCACTTGT<br>CTGCGGTCCACCAAATTCACAATCTACAACAATATGTTCTGT<br>GCGGGATTCCATGAAGGTGGGAGAGATAGCTGCCAGGGAG<br>ACTCAGGGGGTCCCCACGTGACGGAAGTCGAGGGGACGTC<br>ATTTCTGACGGGAATTATCTCATGGGGAGAGGAATGTGCGA<br>TGAAGGGGAAATATGGCATCTACACTAAAGTGTCACGGTAT<br>GTCAATTGGATCAAGGAAAAGACGAAACTCACG<br>TGATAATAG<br>GCTGCCTTCTGCGGGCTTGCCTTCTGGCCATGCCCTTCTTC<br>TCTCCCTTGCACCTGTACCTCT<br>CAAACACCATTGTCATGGTCTTTGAATAAAGCCTGAGTAGG<br>AAGGCGGCCGCTCGAGCATGCATCTAGA | |
| mRNA sequence (transcribed): | GGGAAAUAAGAGAGAAAAGAAGAGUAAGAAGAAAUAUAA<br>GAGCCACC<br>AUGCAGCGCGUCAACAUGAUUAUGGCCGAAUCGCCGGGAC<br>UCAUCACAAUCUGCCUCUUGGGUUAUCUCUUGUCGGCAGA<br>AUGUACCGUGUUCUUGGAUCACGAAAACGCGAACAAAAU<br>UCUUAAUCGCCCGAAGCGGUAUAACUCCGGGAAACUUGAG<br>GAGUUUGUGCAGGGCAAUCUUGAACGAGAGUGCAUGGAG<br>GAGAAAUGCUCCUUUGAGGAGGCGAGGGAAGUGUUUGAA<br>AACACAGAGCGAACAACGGAGUUUUGGAAGCAAUACGUA<br>GAUGGGGACCAGUGUGAGUCGAAUCCGUGCCUCAAUGGG<br>GGAUCAUGUAAAGAUGACAUCAAUAGCUAUGAAUGCUGG<br>UGCCCGUUUGGGUUUGAAGGGAAGAACUGUGAGCUGGAU<br>GUGACGUGCAACAUCAAAAACGGACGCUGUGAGCAGUUU<br>UGUAAGAACUCGGCUGACAAUAAGGUAGUAUGCUCGUGC<br>ACAGAGGGAUACCGGCUGGCGGAGAACCAAAAAUCGUGCG<br>AGCCCGCAGUCCCGUUCCCUUGUGGGAGGGUGAGCGUGUC<br>ACAGACUAGCAAGUUGACGAGAGCGGAGACUGUAUUCCCC<br>GACGUGGACUACGUCAACAGCACCGAAGCCGAAACAAUCC<br>UCGAUAACAUCACGCAGAGCACUCAGUCCUUCAAUGACUU<br>UACGAGGGUCGUAGGUGGUGAGGACGCGAAACCCGGUCA<br>GUUCCCCUGGCAGGUGGUAUUGAACGGAAAAGUCGAUGCC<br>UUUUGUGGAGGUUCCAUUGUCAACGAGAAGUGGAUUGUC<br>ACAGCGGCACACUGCGUAGAAACAGGAGUGAAAAUCACGG<br>UAGUGGCGGGAGAGCAUAACAUUGAAGAGACAGAGCACA<br>CGGAACAAAAGCGAAAUGUCAUCAGAAUCAUUCCACACCA<br>UAACUAUAACGCGGCAAUCAAUAAGUACAAUCACGACAUC<br>GCACUUUUGGAGCUUGACGAACCUUUGGUGCUUAAUUCG<br>UACGUCACCCCUAUUUGUAUUGCCGACAAAGAGUAUACAA<br>ACAUCUUCUUGAAAUUCGGCUCCGGGUACGUAUCGGGCUG<br>GGGCAGAGUGUUCCAUAAGGGUAGAUCCGCACUGGUGUU<br>GCAAUACCUCAGGGUGCCCCUCGUGGAUCGAGCCACUUGU<br>CUGCGGUCCACCAAAUUCACAAUCUACAACAAUAUGUUCU<br>GUGCGGGAUUCCAUGAAGGUGGGAGAGAUAGCUGCCAGG<br>GAGACUCAGGGGGUCCCCACGUGACGGAAGUCGAGGGGAC<br>GUCAUUUCUGACGGGAAUUAUCUCAUGGGGAGAGGAAUG<br>UGCGAUGAAGGGGAAAUAUGGCAUCUACACUAAAGUGUC<br>ACGGUAUGUCAAUUGGAUCAAGGAAAAGACGAAACUCACG<br>UGAUAAUAG<br>GCUGCCUUCUGCGGGCUUGCCUUCUGGCCAUGCCCUUCU<br>UCUCUCCCUUGCACCUGUACCUCU<br>CAAACACCAUUGUCAUGGUCUUUGAAUAAAGCCUGAGUA<br>GGAAG | 5040 |

These modified mRNA sequences can include at least one chemical modification described herein. The G-CSF and/or Factor IX modified mRNA sequence can be formulated, using methods described herein and/or known in the art, prior to transfection and/or administration.

The modified mRNA sequence encoding G-CSF or Factor IX can be transfected in vitro to various cell types such as HEK293, HeLa, PBMC and BJ fibroblast and those described in Table 25 using methods disclosed herein and/or are known in the art. The cells are then analyzed using methods disclosed herein and/or are known in the art to determine the concentration of G-CSF or Factor IX and/or cell viability.

The modified mRNA sequence encoding G-CSF or Factor IX can also be administered to mammals including mat, rats, non-human primates and humans. The serum, surrounding tissue and organs can be collected at pre-determined intervals and analyzed using methods disclosed herein and/or are known in the art to determine the concentration of G-CSF or Factor IX and other pharmacokinetic properties mentioned herein.

Example 33

Microphysiological Systems

The polynucleotides, primary constructs and/or mmRNA described herein are formulated using one of the methods described herein such as in buffer, lipid nanoparticles and PLGA. These formulations are then administered to or contacted with microphysiological systems created from organ chips as described in International Publication Nos. WO2013086502, WO2013086486 and WO2013086505, the contents of each of which are herein incorporated by reference in its entirety.

Example 34

Translation Enhancing Elements (TEEs) in Untranslated Regions

The 5' and/or 3' untranslated regions (UTRs) in the polynucleotides, primary constructs and/or mmRNA described herein may include at least one translation enhancing element (TEE). Such TEE which may be included in the 5'UTR and/or 3'UTR include, but are not limited to, those listed in Table 32, including portion and/or fragments thereof. The TEE sequence may include at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99% or more than 99% of the TEE sequences disclosed in Table 28 and/or the TEE sequence may include a 5-30 nucleotide fragment, a 5-25 nucleotide fragment, a 5-20 nucleotide fragment, a 5-15 nucleotide fragment, a 5-10 nucleotide fragment of the TEE sequences disclosed in Table 32.

TABLE 32

TEE Sequences

| TEE Identifier | Sequence | SEQ ID NO |
|---|---|---|
| TEE-001 | MSCSGCNGMWA | 5041 |
| TEE-002 | RNSGAGMGRMR | 5042 |
| TEE-003 | RNSGAGMGRMRRR | 5043 |
| TEE-004 | RMSCSGCNGMWR | 5044 |
| TEE-005 | GCGAGAGAA | — |
| TEE-006 | GGGAGCGAA | — |
| TEE-007 | GCGAGAGGA | — |
| TEE-008 | GCGAGCGGA | — |
| TEE-009 | CGGAGCGAA | — |
| TEE-010 | CGGAGCGGA | — |
| TEE-011 | ACGAGAGGA | — |
| TEE-012 | ACGAGCGGA | — |
| TEE-013 | GACGAGAGGA | 5045 |
| TEE-014 | GACGAGAGAA | 5046 |
| TEE-015 | AGCGAGCG | — |
| TEE-016 | AGGAGAGGA | — |
| TEE-017 | GCCGAGAGA | — |
| TEE-018 | CGAGAGGCA | — |
| TEE-019 | GAGAGGAGC | — |
| TEE-020 | CGCGGCGGA | — |
| TEE-021 | CGCCGCCGC | — |
| TEE-022 | GCGGCTGAA | — |
| TEE-023 | CCGGCTGAA | — |
| TEE-024 | CGCCGCTGAA | 5047 |

TABLE 32-continued

TEE Sequences

| TEE Identifier | Sequence | SEQ ID NO |
|---|---|---|
| TEE-025 | CGCCGCGGAA | 5048 |
| TEE-026 | CGCCGCCGAA | 5049 |
| TEE-027 | CCCGCGGAA | — |
| TEE-028 | CCCGCCGAA | — |
| TEE-029 | CCCGCTGAA | — |
| TEE-030 | CCCGGCGGA | — |
| TEE-031 | CGCGGCTGA | — |
| TEE-032 | CGGCTGCTA | — |
| TEE-033 | CCCGGCGGA | — |
| TEE-034 | AGCCGCCGCA | 5050 |
| TEE-035 | ACGCCGCCGA | 5051 |
| TEE-036 | GGCATTCATCGT | 5052 |
| TEE-037 | GCATTAGTATCT | 5053 |
| TEE-038 | TCGGTTATTGTT | 5054 |
| TEE-039 | TCCAATTGGGAA | 5055 |
| TEE-040 | ATCTATTGGCCA | 5056 |
| TEE-041 | TTACTGGGTGTT | 5057 |
| TEE-042 | AGGGTGAAGGTC | 5058 |
| TEE-043 | GGTGGGTGTGTC | 5059 |
| TEE-044 | CGCTTCAATGCT | 5060 |
| TEE-045 | TGCTTCAATGCC | 5061 |
| TEE-046 | TGTGTCTTTGCA | 5062 |
| TEE-047 | CACGGGACAGC | 5063 |
| TEE-048 | AAGCTGTACATG | 5064 |
| TEE-049 | GATGGGGGCACA | 5065 |
| TEE-050 | ATATGTGCCCTT | 5066 |
| TEE-051 | TCCTTCTGGGTC | 5067 |
| TEE-052 | GGTGGGTGTGTC | 5068 |
| TEE-053 | GAATGGATGGGG | 5069 |
| TEE-054 | CAXGTGATATTC | 5070 |
| TEE-055 | AGGAGGGTTTGT | 5071 |
| TEE-056 | TGGGCGAGTGGG | 5072 |
| TEE-057 | CGGCTCACCAGT | 5073 |
| TEE-058 | GGTTTCXATAAC | 5074 |
| TEE-059 | GGTGGGTGTGTC | 5075 |
| TEE-060 | TTACTGGGTGTT | 5076 |
| TEE-061 | AAGTCTTTGGGT | 5077 |

TABLE 32-continued

TEE Sequences

| TEE Identifier | Sequence | SEQ ID NO |
|---|---|---|
| TEE-062 | CCGGCGGGU | — |
| TEE-063 | CCGGCGGG | — |
| TEE-064 | CCGGCGG | — |
| TEE-065 | CCGGCG | — |
| TEE-066 | CCGGC | — |
| TEE-067 | CGGCGGGU | — |
| TEE-068 | GGGAGACGGCGGCGGTGGCGGCGCGGGCAGAGCAAGGACGCGGCGGATCCCACTCGCACAGCAGCGCACTCGGTGCCCCGCGCAGGGTCG | 5078 |
| TEE-069 | AAAGAAATGGAATCGAAGAGAATGGAAACAAATGGAATGGAATTGAATGGAATGGAATTGAATGGAATGGGAACG | 5079 |
| TEE-070 | AAAGAAATGGAATCGAAGAGAATGGAAACAAATGGAATGGAATTGAATGGAATGGAATTGAATGGAATGGGAACG | 5080 |
| TEE-071 | AGACAGTCAGACAATCACAAAGAAACAAGAATGAAAATGAATGAACAAAACCTTCAAGAAATATGGGATTATGAAGAGGCCAAATGT | 5081 |
| TEE-072 | AAAAGGAAATACAAGACAACAAACACAGAAACACAACCATCGGGCATCATGAAACCTCGTGAAGATAATCATCAGGGT | 5082 |
| TEE-073 | AGACCCTAATATCACAGTTAAACGAACTAGAGAAGGAAGAGCAAACAAATTCAAAAGCTAGCGGAAAGCAAGAAATAACTAAGACCAG | 5083 |
| TEE-074 | AAAGACTTAAACATAAGACCTAAAACCATAAAAACCACAGAAGAAAACATAGGCAATGCCATTCAGGACATAGGCATGGGCAAAGACTTC | 5084 |
| TEE-075 | AGCAATAACCAAACAACCTCATTAAAAAGTAGGCAAAGGACATAAACAGACACTTTTCAAAAGAAGACATACACGTGGCCAACAAACATATG | 5085 |
| TEE-076 | AGAAAGAATCAAGAGGAAATGCAAGAAATCCAAAACACTGTAACAGATATGATGAATAATGAGGTATGCACTCATCAGCAGACTCGACAT | 5086 |
| TEE-077 | GCACTAGTCAGATCAAGACAGAAAGTCAACGAACAAAGAACAGACTTAAACTACACTCTAGAACAAATGGACCTA | 5087 |
| TEE-078 | AGCAGCCAACAAGCATATGAAATAATGCTCCACAACACTCATCATCAGAGAAATGCAAATCAAAACCAAAAT | 5088 |
| TEE-079 | AATATACGCAAATCAATAAATGTAATCCAGCATATAAACAGTACTAAAGACAAAAACCACATGATTATCTCAATAGATGCAGAAAAGGCC | 5089 |
| TEE-080 | ATGTACACAAATCAATAAATGCAGTCCAGCATATAAACAGAACCAAACACAAAAACCACATGATTATCTCAATAGATGCAGAAAAGGCCTTT | 5090 |
| TEE-081 | TATACCACACAAATGCAAAAGATTATTAGCAACAATTATCAACAGCAATATGTCAACAAGTTGACAAACCTAGAGGACATGGAT | 5091 |
| TEE-082 | AAACACACAAAGCAACAAAAGAACGAAGCAACAAAAGCATAGATTTATTGAAATGAAAGTACATTCTACAGAGTGGGGGCAGGCT | 5092 |
| TEE-083 | GAAATCATCATCAAACGGAATCGAATGGAATCATTGAATGGAATGGAATGGAATCATCATGGAATGGAAACG | 5093 |

TABLE 32-continued

TEE Sequences

| TEE Identifier | Sequence | SEQ ID NO |
|---|---|---|
| TEE-084 | AACAGAATGGAATCAAATCGAATGAAATGGAATGG AATAGAAAGGAATGGAATGAAATGGAATGGAAAGG ATTCGAATGGAATGCAATCG | 5094 |
| TEE-085 | TACAAAGAACTCAAACAAATCAGCAAGAACAAAAA CAATCCCAACAAAATGTTGGACAAAGACATGAATAG ACAATTCTCGAAAGAAGATGTACAAATGGCT | 5095 |
| TEE-086 | TGTTGAGAGAAATTAAACAAAGCACAGATAAATGGA AAAACGTGTTCATAGATTGAAAGACTTCATGTTGTAT GGTGTC | 5096 |
| TEE-087 | AAACGATTGGACAGGAATGGAATCACCATCGAATGG AAACGAATGGAATCTTCGAATGGAATTGAATGAAAT TATTGAACGGAATCAAATAGAATCATCATTGAACAG AATCAAATTGGATCAT | 5097 |
| TEE-088 | AACAATAAACAAACTCCAACTAGACACAATAGTCAA ATTGCTGAAAATGAAATATAAAGGAACAATCTCGAT GGTAGCCCAAGGA | 5098 |
| TEE-089 | AAATCAATAAATGTAATTCAGCATATAAACAGAACC AAAGACAAAAACCACATGATTATCTCAATAGATGCA GAAAAGGCCTTT | 5099 |
| TEE-090 | GCTCAAGGAAATAAAATAGGACACAAAGAAATGGA AAAACATTCCATACTCATGGATAGAAAGAATCAATA TCATGAAATGGCC | 5100 |
| TEE-091 | AACATACGCAAATCAATAAATGTAATCCAGCATATA AACAGAACCAAAGACAAAAACCACATGATTATCTCA ATAGATGCAGAAAAGGCC | 5101 |
| TEE-092 | AACAATCACTAGTCCTTAAGTAAGAGACAACACCTT TTGTCACACACAGTTTGTCCTAACTTTATCTTGGTAA TTGGGGAGACC | 5102 |
| TEE-093 | AGAAAACACACAGACAACAAAAAACACAGAACGAC AATGACAAAATGGCCAAGC | 5103 |
| TEE-094 | ACACAACAACCAAGAAACAACCCCATTAAGAAGTGG GAAAATACATGAATAAACACATCTCAAAAGAAGAC AAACAAGTGGCTAAC | 5104 |
| TEE-095 | ACAGCAGAAAACGAACATCAGAAAATCACTCTACAT GATGCTTAAATACAGAGGGCAAGCAACCCAAGAGA AAACACCACTTCCTAAT | 5105 |
| TEE-096 | GAATAGAACAGAATGGAATCAAATCGAATGAAATG GAATGGAATAGAAAGGAATGGAATGAAATGGAATG GAAAGGATTCGAATGGAATG | 5106 |
| TEE-097 | TAAGCAGAGAAAATATCAACACGAAAATAATGCAA GGAGAAAAATACAGAACAATCCAAAATGTGGCC | 5107 |
| TEE-098 | GAACAATCAATGGAAGCAGAAACAAATAAACCAAG GTGTGCATCAAGGAATACATTCACGCATGATGGCTG TATGAGTAAAATG | 5108 |
| TEE-099 | GATCAATAAATGTAATTCATCATATAAACAGAGAAC TAAAGACAAAAACACATGATTATCGCAATACATGCA GAAAAGGCC | 5109 |
| TEE-100 | GACAAGAGTTCAGAAAGGAAGACTACACAGAAATA CGCATTTTAAAGTCACTGACATGGAGATGACACTTA AAACCATGAACATGGATGGG | 5110 |
| TEE-101 | AAGCAAAGAAAGAATGAAGCAGCAAAAGAACGAAA GCAGGAATTTATTGAAAACCAAAGTACACTCCACAG TATGGGAGCGGACCCGAGCA | 5111 |
| TEE-102 | ACCAACATAAGACAAAGAAACATCCAGCAGCTGCCT ATGCAAAAGATTACAATGTGTCAAACAAGAGGGCA ATG | 5112 |

TABLE 32-continued

TEE Sequences

| TEE Identifier | Sequence | SEQ ID NO |
|---|---|---|
| TEE-103 | GGACAAATTGCTAGAAATAAACAAATTACCAAAAAT GATTCAAGTAGAGACAGAGAATCAAAATAGAACTAC ACATAAGTGGGCCAAG | 5113 |
| TEE-104 | AACATAATCCATCAAATAAACAGAACCAAAGACAAA AACCACATGATTATCTCAATAGATGCAGAAAAGGCC TTC | 5114 |
| TEE-105 | AAAATCAATATGAAAACAAACACAAGCAGACAAAG AAAATTGGGCAAAAGGTTTGAGCAGACACTTCACCA AAGAAGTACAAATGGCAAATCAGCA | 5115 |
| TEE-106 | AACCAAATTAGACAAATTGGAAATCATTACACATAA CAAAAGTAATAAACTGTCAGCCTCAGTAGTATTCATT GTACATAAACTGGCC | 5116 |
| TEE-107 | AAGGAATTTAAGCAAATCAACAAGCAAAACCAAAAT AATCCCATTAAAAAGTGGGTAAAGGACATGAATACA CACTTGTCAATAGAGGACATTCAAGTGGCCAAC | 5117 |
| TEE-108 | TAACCTGATTTGCCATAATCCACGATACGCTTACAAC AGTGATATACAAGTTACATGAGAAACACAAACATTT TGCAAGGAAACTGTGGCCAGATG | 5118 |
| TEE-109 | AACTAACACAAGAACAGAAAACCAAACATCACATGT TCTCACTCATAAGCGGGAGCTGAACAATGAGAACAC ACGGACACAGGGAGAGGAACATG | 5119 |
| TEE-110 | TAAACTGACACAAACACAGACACACAGATACACACA TACATACAGAAATACACATTCACACACAGACCTGGT CTTTGGAGCCAGAGATG | 5120 |
| TEE-111 | ATCAACAGACAACAGAAACAAATCCACAAAGCACTT AGTTATTAGAACTGTCATACAGACTGTACAACAACC ACATTTACCAT | 5121 |
| TEE-112 | AAATAAGCCAACGGTCATAAATTGCAAAGCCTTTTA CAATCCAAACATGATGGAAACGATATGCCATTTTGA AGGTGATTTGAAAAGCACATGGTTT | 5122 |
| TEE-113 | AAACAGTTCAAAAATTATTGCAACAAAATGAGAGAG ATGAGTTTATCTTGCAAACTAATGGATGGTAGCAGT GACAGTGGCAAAACGTGGTTTGATTCT | 5123 |
| TEE-114 | TAAGCAACTTCAGCAAAGTCTCAGGATACAAAATCA ATGTACAAAAATCACAAGCATTCTTATACACCAACA ACAGACAAACAAGAGTGCCAAATCATG | 5124 |
| TEE-115 | AGCAAACAAACAAACAAACAAACAAACTATGACAG GAACAAAACGTCACATATCAACATTAACAAAGAATG TAAACAGCCTAAATGCTTCACTTAAAAGTTATAGAC AGGGGCTGGGCATGGTGGCTCACGCC | 5125 |
| TEE-116 | GGAAATAACAGAGAACACAAACAAATGGGAAAACA TTCCATGTTCATGGATAGGAAGAATCAATATTGTGA AAATGGCCATACT | 5126 |
| TEE-117 | AGCAACTTCAGCAAAGTCTCAGGATACAAAATCAAT GTACAAAAATCACAAGCATTCTTATACACCAATAAC AGACAAACAGAGAGCC | 5127 |
| TEE-118 | AGATAAGAATAAGGCAAACATAGTAATAGGGAGTTC ATGAATAACACACGGAAAGAGAACTTACAGGGCTGT GATCAGGAAACG | 5128 |
| TEE-119 | AGGAAATAAAAGAAGACACAAACAAATGGAAGAAC ATTCCATGCTTATGGATAGGGAGAATCAGTATCGTG AAAATGGCCATACT | 5129 |
| TEE-120 | AACATACGAAAATCAATAAACGTAATCCAGCATATA AACAGAACCAAAGACAAAACCACATGATTATCTCA ATAGATGCAGAAAAGGCCTTT | 5130 |

TABLE 32-continued

TEE Sequences

| TEE Identifier | Sequence | SEQ ID NO |
|---|---|---|
| TEE-121 | AATGGACTCGAATGAAATCATCATCAAACGGAATCG AATGGAATCATTGAATGGAATGGAATGGAATCATCA TGGAATGGAAACG | 5131 |
| TEE-122 | AAGATTTAAACATAAGACCTAAAACGACAAAAATCC TAGGAGAAAACCTAAGCAATACCATTCAGGACATAG GCATGGGCAAAGACTTCATG | 5132 |
| TEE-123 | TAATGAGAAGACACAGACAACACAAAGAATCACAG AAACATGACACAGGTGACAAGAACAGGCAAGGACC TGCAGTGCACAGGAGCC | 5133 |
| TEE-124 | TAAACGTTAGACCTAAAACCATAAAAACCCTAGAAG AAAACCTAGGCATTACCATTCAGGACATAGGCATGG GCAAGGAC | 5134 |
| TEE-125 | GAATTGAATTGAATGGAATGGAATGCAATGGAATCT AATGAAACGGAAAGGAAAGGAATGGAATGGAATGG AATG | 5135 |
| TEE-126 | GTAATGGAATGGAATGGAAAGGAATCGAAACGAAA GGAATGGAGACAGATGGAATGGAATGGAACAGAG | 5136 |
| TEE-127 | AGAGAAATGCAAATCAAAACCACAATGGAATACCAT CTCACGCCAGTCAGAATGGCAATTATTAAAAAATCA CAACAATTAATGATGGCAAGGCTGTGG | 5137 |
| TEE-128 | AACATACACAAATCAATAAACGTAATCCAGCTTATA AACAGAACCAAAGACAAAAACCACATGATTATCTCA ATAGATGCGGAAAAGGCC | 5138 |
| TEE-129 | TAAACAGAACCAAAGACAAAAATCACATGATTATCT CAATAGATGCAGAAAAGGCC | 5139 |
| TEE-130 | AATGGAATGCAATCGAATGGAATGGAATCGAACGGA ATGGAATAAAATGGAAGAAAACTGGCAAGAAATGG AATCG | 5140 |
| TEE-131 | AGATAAAAAGAACAGCAGCCAAAATGACAAAAGCA AAAAGCAAATCGTGTTAGAGCCAGGTGTGGTGATG TGTGCT | 5141 |
| TEE-132 | AGGAAAGTTTTCAATATGAGAAAGATACAAACCAAC AGAATAAGCAAACTGGATAAACAGAAAATACAGAG AGAGCCAAGG | 5142 |
| TEE-133 | GCAATCTCAGGATACAAAATCAATGTGCAAAAATCA CAAGCATTCTCATACACCAATAACAGACAAACAGAG CCAAATCATG | 5143 |
| TEE-134 | AGCATTCATATCTTGCAGTGTTGGGAAAGAGTGAGA GGTTGTGATGTCAAGAAGGATAGGTCAGAAGTGGAA GGTATGGGGGATTGTGCCTGCTGTCATGGCT | 5144 |
| TEE-135 | AGCAACTTCAGCAAAGTCTCAGGATACAAAATCAAT GTGCAAAAATCACAAGCATTCTTATACACCAATAAC AGACAAACAGAGAGCC | 5145 |
| TEE-136 | AGCAACTTCAGCAAAGTCTCAGGATACAAAATCAAT GTGCAAAAATCACAAGCATTCTTATACACCAACAAC AGACAAACAGAGAGCC | 5146 |
| TEE-137 | TAAGCCGATAAGCAACTTCAGCAAAGTCTCAGGAGA CAAAATCAATGTGCAAAAAATCACAAGCATTCTTAT ACACTAATAACAGACAAACAGAGAGCCAAATCATG | 5147 |
| TEE-138 | AACGTGACATACATACAAAAAGTTTTTAGAGCAAGT GAAATTTTAGCTGCTATATGTTAATTGGTGGTAATCCC | 5148 |
| TEE-139 | TACGCAAATCGATAAATGTAATCCAGCATATAAACA GAACCAAAGACAAAAACCACATGATTATCTCAATAG ATGCAGAAAAGGCC | 5149 |

TABLE 32-continued

TEE Sequences

| TEE Identifier | Sequence | SEQ ID NO |
|---|---|---|
| TEE-140 | GCAATCGAATGGAATGGAATCGAACGGAATGGAATA AAATGGAAGAAAACTGGCAAGAAATGGAATCG | 5150 |
| TEE-141 | TTGAATCGAATGGAATCGAATGGATTGGAAAGGAAT AGAATGGAATGGAATGGAATTGACTCAAATGGAATG | 5151 |
| TEE-142 | TAAAGAAAAACAAACAAACAGAAATCAATGAAAAT CCCATTCAAAGGTCAGCAACCTCAAAGACTGAAGGT AGATAAGCCCACAAGGATG | 5152 |
| TEE-143 | GTCATATTTGGGATTTATCATCTGTTTCTATTGTTGTT GTTTTAGTACACACAAAGCCACAATAAATATTCTAG GCT | 5153 |
| TEE-144 | AAAAGTACAGAAGACAACAAAAAATGAGAGAGAGA AAGATAACAGACTATAGCAGCATTGGTGATCAGAGC CACCAG | 5154 |
| TEE-145 | AACCCACAAAGACAACAGAAGAAAAGACAACAGTA GACAAGGATGTCAACCACATTTTGGAAGAGACAAGT AATCAAACACATGGCA | 5155 |
| TEE-146 | AAAGACCGAAACAACAACAGAAACAGAAACAAACA ACAATAAGAAAAAATGTTAAGCAAAACAAATGATTG CACAACTTACATGATTACTGAGTGTTCTAATGGT | 5156 |
| TEE-147 | AATCAGTAAACGTAATACAGCATATAAACAGAACCA AAGACAAAAACCACATGATTATCTCAATAGATGCAG AAAAGGCC | 5157 |
| TEE-148 | AAGCAACTTCAGCAAAGTCTCAGGACACAAAATCAA TATGCGAAAATCACAAGCATTCCTATACACCAATAA TAGACAAACAGAGAGCCAAATCATG | 5158 |
| TEE-149 | AGCAACTTCAGCAAAATCTCAGGATACAAAATCAAT GTACAAAAATCACAAGCATTCTTATACACCAACAAC AGACAAACAGAGAGCC | 5159 |
| TEE-150 | TAATGCAAACTAAAACGACAATGAGATATCAATACA TAACTACCAGAAAGGCTAACAAAAAAACAGTCATAA CACACCAAAGGCTGATGAGTGAGGATGTGCAG | 5160 |
| TEE-151 | AGCAACTTCAGCAAAGTCTCAGGATACAAAATCGAT GTGCAAAAATCACAAGCATTCTTATACACCAATAAC AGGCAAACAGAGAGCC | 5161 |
| TEE-152 | GATATATAAACAAGAAAACAACTAATCACAACTCAA TATCAAAGTGCAATGATGGTGCAAAATGCAAGTATG GTGGGGACAGAGAAAGGATGC | 5162 |
| TEE-153 | AAGACAGAACACTGAAACTCAACAGAGAAGTAACA AGAACACCTAAGACAAGGAAGGAGAGGGAAGGCAG GCAG | 5163 |
| TEE-154 | TAAGACACATAGAAAACATAAAGCAAAATGGCAGA TGTAAATGCAACCTATCAATCAAAACATTACGAATG GCTT | 5164 |
| TEE-155 | TGAAACAAATGATAATGAAAATACAACATACCAAAC ATACGAGATACAGTAAAAGCAGTACTAAGATGCAAG TATATATTGCTACAAGTGCCTAC | 5165 |
| TEE-156 | AATGTAATCCAGCATATAAACAGAGCCAAAGACAAA AACCCACATGATTATCTCAATAGATGCAGAAAAAGCC TTTGACAAAATTCAACAACCCTTCATGCTAAAAACTC TCAATAAATTAGGTATTGATGGGACG | 5166 |
| TEE-157 | ACAAAATTGATAGACCACTAGCAAGACTAATAAAGA AGAAAAGAGAGAAGAATCATTACCATTCAGGACATA GGCATGGGCAAGGAC | 5167 |
| TEE-158 | AAGGATTCGAATGGAATGCAATCGAATGGAATGGAA TCGAACGGAATGGAATAAAATGGAAGAAAACTGGC AAGAAATGGAATCG | 5168 |

TABLE 32-continued

TEE Sequences

| TEE Identifier | Sequence | SEQ ID NO |
| --- | --- | --- |
| TEE-159 | GATCATCAGAGAAACAGAGAAATGCAAATTAAAACC ACAATGAGATACTATCTCCACACAAGTCAGAATGGC TAT | 5169 |
| TEE-160 | ATCAAAAGAAAAGCAACCTAACAAATACGGGAAGA ATATTTGAATAGACATTTCACAGGAAAAGATATATG AATGGCCAAAAAGCAAATGAAAAG | 5170 |
| TEE-161 | AACAGCAATGACAATGATCAGTAACAACAAGACTTT TAACTTTGAAAAAATCAGGACC | 5171 |
| TEE-162 | AAGAGCCTGAATAGCTAAAGTGATCATAAGCAAAAA GAACAAAGTCGGAAGCATCACATTACCTGACTTCAA ACTATACTCAAAGGCTATG | 5172 |
| TEE-163 | ACTCAGGAAAAATAACGAATCCAACTCACAGGAGAA AGAAGTACAAACCAGAAACCATTTCAAATTACAAG GACCAGAATACTCATGTTGGCTGGCCAGT | 5173 |
| TEE-164 | TTGACCAGAACACATTACACAATGCTAATCAACTGC AAAGGAGAATATGAACAGAGAGGAGGACATGGATA TTTTGTG | 5174 |
| TEE-165 | AACATATGGAAAAAAACTCAACATCACTGATCATTA GAGAAATGCAAATCAAAACCACAATGAGATACCATC TCACGCCAGTCAGAATGGCG | 5175 |
| TEE-166 | AGCAACTTCAGCAAAGACTCAGGATACAAAATCAAT GTGCAAAAATCACAAGCATTCTTATACACCAATAAC AGACAGAGAGCCAAAT | 5176 |
| TEE-167 | TGGGATATGGGTGAAAGAACAAGTTTGCAGAAAAGA TACAGTGAATTATGGACCATGAGTTCGGGAAAGAAG GGTAGGACTGCG | 5177 |
| TEE-168 | AGCAGTGCAAGAACAACATAACATACAAGTAAACA AACACATGGGGCCAGGTAATAAAAAGTCAGGCTCAA GAGGTCAG | 5178 |
| TEE-169 | AAGGAAAAGTAAAAGGAACTTAACACCTTCAAGAA AAGACAGACAAATAACAAAACAGCAGTTTGATAGA ATGAGATATCAGGGGATGGCA | 5179 |
| TEE-170 | GCTAGTTCAACATATGCAAATCAATAAACGTAATCC ATCACATAAACAGAACCAATGACAAAAACCACGATT ATCTCAATAGATGCAGAAAAGGCC | 5180 |
| TEE-171 | AACATCACTGATCATTAGAAACACACAAATCAAAAC CACAATAAGATACCATCTAACACCAGTCACAATGGC TATT | 5181 |
| TEE-172 | AGAGCATCCACAAGGCCCAATTCAAAGAATCTGAAA TAATGTATTGTTACTGCAACAGTTGTGAGTACCAGTG GCATCAG | 5182 |
| TEE-173 | GGAATAACAACAACAACAACCAAAAGACATATAGA AAACAAACAGCACGATGGCAGATGTAAAGCCTACC | 5183 |
| TEE-174 | AAACGCAGAAACAAATCAACGAAAGAACGAAGCAA TGAAAGACAAAGCAACAAAAGAATGGAGTAAGAAA GCACACTCCACAAAGTGGAAGCAGGCTGGGACA | 5184 |
| TEE-175 | AGCAACTTCAGCAAAGTCTCAGGATACAAAATCAAT GTGCAAAAATCACAAGCATTCCTATACACCAACAAC AGACAAACAGAGAGCC | 5185 |
| TEE-176 | AGCAACTTCAGCAAAGTCTCAGGATACAAAATCAAT GGGAAAAAATCACAAGCATTCCTATACATCAATAAC AGACAAACAGAGAGCC | 5186 |
| TEE-177 | ACACATTTCAAGGAAGGAAACAAGAACAGACAGAA ACACAACATACTTCATGAAACCACATTTTAGCATCCT GGCCGAGTATTCATCA | 5187 |

TABLE 32-continued

TEE Sequences

| TEE Identifier | Sequence | SEQ ID NO |
|---|---|---|
| TEE-178 | AGCAACTTCAGCAAAGTCTCAGGACACAAAATCAAT GTGCAAAAATCACAAGCATTCTTATACACCAATAAC AGACAAACAGAGAGCC | 5188 |
| TEE-179 | TATTTTACCAGATTATTCAAGCAATATATAGACAGCT TAAAGCATACAAGAAGACATGTATAGATTTACATGC AAACACTGCACCACTTTACATAAGGGACTTGAGCAC | 5189 |
| TEE-180 | CCCAACTTCAAATTATACTACAAGGCTACAGTAATC AAAAAAGCATAGTACTATTACAAAAACAGACACACA GGCCAATGGAATACAAT | 5190 |
| TEE-181 | AGAAAGGATTCGAATGGAATGAAAAGAATTGAAT GGAATAGAACAGAATGGAATCAAATCGAATGAAAT GGAATGGAATAGAAAGGAATGGAATG | 5191 |
| TEE-182 | GTTTACAGTCAAGTGTACAAACAGAATATAAGCAAA CAAAAGAGAACATATACTTACAAACTATGCTAAGTG CCATGAAGGAAAAG | 5192 |
| TEE-183 | AAGAGTATTGAAGTTGACATATCTAGACTGATCAAG AACAAAGACAAAAGGTACAGATTATCAAGAAAATG AGCGGGCAAAGCAAGATGGCC | 5193 |
| TEE-184 | AGTAGAATTGCAATTGCAAATTTCACACATATACTCA CACACAAGTACACACATCCACTTTTACAACTAAAAA AACTAGCACCCAGGACAGGTGCAGTGGCT | 5194 |
| TEE-185 | TGAATGCTATAGAGCAGTAAAAACAAATAAATGAAC TACATTACAGCTACTTACAACCATATGAAAGAATAT AACCATAACAATGATGAGTGGACAAAAGCTAAGTGT GAAAGAATGCATAGTGCTACAGCAGCCAACATTTAC AGC | 5195 |
| TEE-186 | GAATGGAATCAAATAGAATGGAATCGAAACAAATG GAATGGAATGGAATGGGAGCTGAGATTGTGTCACTG CAC | 5196 |
| TEE-187 | TAAAAGTGTGCTCAACATCATTGATCATCAGAGAAA TGCAAATCAAAACTACAATGAGATATCATCTCATCC CAGTCAAAGTGGCT | 5197 |
| TEE-188 | TCAGACCATAGCAGATAACATGCACATTAGCAATAC GATTGCCATGACAGAGTGGTTGGTG | 5198 |
| TEE-189 | ACAAACAATCCAATTCGAAAATGGGCAAGATATTTC ACCAAAGACATGAGCTGATATTTCAC | 5199 |
| TEE-190 | AGGAAAAACAACAACAACAACAGGAAAACAACCTC AGTATGAAGACAAGTACATTGATTTATTCAACATTTA CTGATCACTTTTCAGGTGGTAGGCAG | 5200 |
| TEE-191 | AACAAAACAAAAACCCAACTCAATAACAAGAAGAC AAACAACCCAATTTAAAATGAGCAAAGAACTTGATA AACATGTCTCCAAAGAAGATACGGCCAAAGAGCAC | 5201 |
| TEE-192 | ATACAACTAAAGCAAATATAAGCAACTAAAGCAACA GTACAACTAAAGCAAAACAGAACAAGACTGCCAGG GCCTAGAAAAGCCAAGAAC | 5202 |
| TEE-193 | AACAACAACAACAGGAAAACAACCTCAGTATG AAGACAAGTACATTGATTTATTCAACATTTACTGATC ACTTTTCAGGTGGTAGGCAGACC | 5203 |
| TEE-194 | AGAGAGTATTCATCATGAGGAGTATTACTGGACAAA TAATTCACAAACGAACAAACCAAAGCGATCATCTTT GTACTGGCTGGCTA | 5204 |
| TEE-195 | AGTAAATCACCATAAAGAAGGTAAGAGTTCATTCAC AAAAACAACAAACTGAAGAATCAGGCCATAGTA | 5205 |
| TEE-196 | AAAATAGAATGAAAGAGAATCAAATGGAATTGAATC GAATGGAATCGAATGGATTGGAAAGGAATAGAATG GAATGGAATGGAATG | 5206 |

TABLE 32-continued

TEE Sequences

| TEE Identifier | Sequence | SEQ ID NO |
|---|---|---|
| TEE-197 | AAAAGATGCAAAAGTAGCAAATGCAATGTTAAAACA AGCAAAGAAAGAATCAGGTGGACCACATAGTGCAGT GCTTCTC | 5207 |
| TEE-198 | TTCACAGCAGCATTACGCACAATAGCCAGAAGGTGG GAACAGACAAAATGCCTTTTGATGGG | 5208 |
| TEE-199 | CCATAACACAATTAAAAACAACCTAAATGTCTAATA GAAGAACACTGTTCAGACCGGGCATGGTGGCTTATA CC | 5209 |
| TEE-200 | TGGATTTCAGATATTTAACACAAAATAGTCAAAGCA GATAAATACTAGCAACTTATTTTTAATGGGTAACATC ATATGTTCGTGCCTT | 5210 |
| TEE-201 | ATCATTGAATGCAATCACATGGAATCATCACAGAAT GGAATCGTACGGAATCATCATCGAATGGAATTGAAT GGAATCATCAATTGGACTCGAATGGAAACATCAAAT GGAATCGATTGGAAGTGTCGAATGGACTCG | 5211 |
| TEE-202 | AGAAACAGCCAGAAAACAATTATTACCTACAGCATT AAAACTATTCAAATGACAGCATATTTTTCAGCAGAA ATCATGAAGGCCAGAAGGACGTGTCAT | 5212 |
| TEE-203 | AAAATGATCATGAGAAAATTCAGCAACAAAACCATG AAATTGCAAAGATATTACTTTTGGGATGGAACAGAG CTGGAAGGCAAAGAG | 5213 |
| TEE-204 | AACCACTGCTCAAGGAAATAAGAGAGAACACAAAC AAATGAAAAAACATTCCATGCTCATGGATAGGAAGA ATCAG | 5214 |
| TEE-205 | TACTCTCAGAAGGGAAGCAGATATTCAGCATAAATC ATATTGTTTGTACAAAGAGTCTGGGCATGGTGAATG ACACT | 5215 |
| TEE-206 | TATAGTTGAATGAACACACATACACACACACATGCC ACAAAACAAAACAAAGTTATCCTCACACACAGGAT AGAAACCAAACCAAATCCCAACACATGGCAAGATGAT | 5216 |
| TEE-207 | GCTCAAAGAAATCAGAAATGACACAAGCAAATGGA AAAACATGCCATGTTCATGAATATGAAGAATCAATA TTGTTAAAATGGCCATACTGCTCA | 5217 |
| TEE-208 | GGATACAAAATCAATGTACAAAAATCACAAGCATTC TTATACACCAATAACAGACAAACAGAGAGCC | 5218 |
| TEE-209 | AGCAACTTCAGCAAAGTCTCAGGATACAAAATCAAT GTACAAAAATCACAAGCATTCTTATACACCAACAAC AGACAAACAGAGAGCC | 5219 |
| TEE-210 | AGGAGAATAGCAGTAGAATGACAAAATTAGATTTTC ACATGAAACTTGATGACAGTGTAGGAAATGGACTGA AAGGACAAGAC | 5220 |
| TEE-211 | AGCAACTTCAGCAAAGTCTCGGGATACAAAATCAAT GTGCAAAAATCACAAGCATTCCTATACACCAATAAC AGGCAAACAGAGAGCC | 5221 |
| TEE-212 | AAGTTCAAACATCAGTATTAACCTTGAACATCAATG GCCTACATGCATCACTTAAAACATACAGACAGGCAA ATTGGGTTAAGAAAACAAACAAGCAAACAAAACAT GTTCCAAACATTTGTTGGCTAT | 5222 |
| TEE-213 | AAGAAACAATCAAAAGGAAGTGCTAGAAATAAAAC ACACTGTAATAGAAAAGAAGAATGCCTTATGGGCTT ATCAATAGACTAGACATGGCCAGG | 5223 |
| TEE-214 | AAAGAAAGACAGAGAACAAACGTAATTCAAGATGA CTGATTACATATCCAAGAACATTAGATGGTCAAAGA CTTTAAGAAGGAATACATTCAAAGGCAAAAGTCAC TTACTGATTTTGGTGGAGTTTGCCACATGGAC | 5224 |

TABLE 32-continued

TEE Sequences

| TEE Identifier | Sequence | SEQ ID NO |
|---|---|---|
| TEE-215 | AGCAACTTCAGCAAAGTTTCAGGATACAAAATCAAT GTGCAAAAATCACAAGCATTCTTATACACCAACAAC AGACAAACAGAGAGCC | 5225 |
| TEE-216 | AGAATCAAATGGAATTGAATCGAATGGAATCGAATG GATTGGAAAGGAATAGAATGGAATGGAATGGAATG | 5226 |
| TEE-217 | AAACAGAACCACAGATATCTGTAAAGGATTACACTA TAGTATTCAACAGAGTATGGAACAGAGTATAGTATT CAACAGAGTATGCAAAGAAACTAAGGCCAGAAAG | 5227 |
| TEE-218 | AAAAAATGTTCAACATCACTAGTCAGCAGAGAAATG CAAATCAAAATCACAATGAGATAACTTCTCACACCA GACAGCATGGC | 5228 |
| TEE-219 | GAATCCATGTTCATAGCACAACAACCAAACAGAAGA AATCACTGTGAAATAAGAAACAAAGCAAAACACAG ATGTCGACACATGGCA | 5229 |
| TEE-220 | AGGATACAAAATCAAAGTGCAAAAATCACAAGCATT CTTATACACCAATAACAGACAAACAGAGAGCC | 5230 |
| TEE-221 | AACAGATTTAAACAAACCAACAAGCAAAAAACGAA CAACTCCATTCAAACATGGACAAAAGCACGAACAG ACACTTTTCAAAGAAGACATACATGTGGCC | 5231 |
| TEE-222 | AAAGACAATATACAAATGGCCAATAAGCACATGAAA AGACGCTCAACATCCTTAGTCGTTAAGGCAATGCAA ATCAAAACCACAATG | 5232 |
| TEE-223 | TAAACAACGAGAACACATGAACACAAAGAGGGGAA CAACAGACACCAAGACCTTCTTGAGGGTGGAGGATG GGAGGAGGGAG | 5233 |
| TEE-224 | GGTTCAACTTACAATATTTTGACTTGACAACAGTGCA AAAGCAATACACGATTAGTAGAAACACACTTCCAAT GCCCATAGGACCATTCTGC | 5234 |
| TEE-225 | AGCAACTTCAGCAAAGTCTCAGGATACAAAATCAAT GAGCAAAAATCACAAGCATTCTTACACACCAATAAC AGACAAACAGAGAGCC | 5235 |
| TEE-226 | AATCCAGCATATAAACAGAACCAAAGACAAAAACC ACATGATTATCTCAATAGATGCAGAAAAGGCC | 5236 |
| TEE-227 | TGAAAATACAAATGACCATGCAAGTAATTCCGCAGG GAGAGAGCGGATATGAACAAACAGAAGAAATCAGA TGGGATAGTGCTGGCGGGAAGTCA | 5237 |
| TEE-228 | GCAAATGATTATAAGTGCTGTTATAGAAACATTCAA AGACCAGAAAAGGACCACAATGGCTGACCAC | 5238 |
| TEE-229 | AGTCAATAACAAGAAGACAAACAACCCAATTACAAA ATGGGATATGAATTTAATAGATGTTACTCCAAGGAA GATACACAAATGGCCAAC | 5239 |
| TEE-230 | ATGGTTAAAACTCAACAATGAAAACACAAACAGCGC AATTTAAAAATGGGCAAAATGACAGGCCAGACCCAG TGGCTCATGCG | 5240 |
| TEE-231 | TAACTACTCACAGAACTCAACAAAACACTATACATG CATTTACCAGTTTATTATAAAGATACAAGTCAGGAA CAGCCAAATGGAAGAAATGTAAATGGCAAG | 5241 |
| TEE-232 | AACAGACCATAAATAAACACAGAAGACACACGAGT GTAAAGTCAGTGCCCCGCTGCGAATTAAATCGGGGT GATGTGATGGCGAGTGAGTGGGTAGTT | 5242 |
| TEE-233 | GAATAGAATAGAATGGAATCATCGAATGGAATCGAA TGGAATCATCATGATATGGAATTGAGTGGAATC | 5243 |
| TEE-234 | GGAATCTATAATACAGCTGTTTATAGCCAAGCACTA AATCATATGATACAGAAAACAAATGCAGATGGTTTG AAGGGTGGG | 5244 |

TABLE 32-continued

TEE Sequences

| TEE Identifier | Sequence | SEQ ID NO |
| --- | --- | --- |
| TEE-235 | AAGATAGAGTTGAAACAGTGGACAATTAAAGAGTAA TTTGGAAGAATGGTGAAATTACAGCCATGCTTTGAA TCAGGCGGGTTCACTGGC | 5245 |
| TEE-236 | TGAAAAGAAGAATGACCATAAGCAAGCAGATGAAA AACAAAACAGAATTTTTACAGACGTCTTGGACTGAT ATCTTGGGC | 5246 |
| TEE-237 | AGGAATCTATAATACAGCTGTTTATAGCCAAGCACT AAATCATATGATACAGAAAACAAATGCAGATGGTTT GAAGGGTGGG | 5247 |
| TEE-238 | AGGAAAAGAAAGAAATAGAAAATGCGAAATGGTAA GAAAAAACAGCATAATAAACATTTGTATGGTGTTGA TGGACAATGCATT | 5248 |
| TEE-239 | TAACAGTACCAAAAAACAGTCATAATCTTCAAGAGC TTAAATTTAGCATGAAAGGAAGACATTCATCAAAGA ATCACACAAAGGAATGTAAAATTAAATGGAGATTAG TGCCAGGAAAGAGC | 5249 |
| TEE-240 | GCAAAACACAAACAACGCCATAAAAAACTGGGCAA AGGATATGAACAGACATTTTTCAAAACAAAACATAC TTATGGCCAAC | 5250 |
| TEE-241 | AACAAAATTGAACAACATGCAAAGAAACATAAACG AAGCAATGAAAGTGTGCAGATCCACTGAAATGAAAG TGCTGTCCAGAGTGGGAGCCAGCTCGAGA | 5251 |
| TEE-242 | GAATGGAATCAACATCAAACGGAATCAAACGGAATT ATCGAATGGAATCGAAGAGAATCATCGAATGGCCAC GAATGGAATCATCTAATGGAATGGAATGGAATAATC CATGG | 5252 |
| TEE-243 | TACAAGAAAATCACAGTAACATTTATAAAACACAGA AGTGTGAACACACAGCTATTGACCTTGAAAACAGTG AAAGAGGGTCAGCTGTAGAACTAAGACATAAGCAA AGTTTTTCAATCAAGAATACATGGGTGGCC | 5253 |
| TEE-244 | AAGAATTGGACAAAACACACAAACAAAGCAAGGAA GGAATGAAAGGATTTGTTGAAAATGAAAGTACACTC CACAGTGTGGGAGCAG | 5254 |
| TEE-245 | ACAGTTAACAAAAACCGAACAATCTAATTACGAAAT GAACAAAAGATATGAACAGACATTTCACCCGAGAGT ATACAGGGGCCAGGCATGGT | 5255 |
| TEE-246 | AAACGCACAAACAAAGCAAGGAAAGAATGAAGCAA CAAAAGCAGAGATTTATTGAAAATGAAAAATACACT CCACAGGGTGGG | 5256 |
| TEE-247 | CACCCATGAGTCATTAGGTAAATGCAAATCAAAACCA CAATGAAATACTTCACACCCATGAAGATGGCTATAA TAAAAAAACAGACA | 5257 |
| TEE-248 | AGCAACTTCAGCAAAGTCTCAGGAGACAAAATCAAT GTACAAAAATCACAAGCATTCTTATACACCAATAAC AGACAAACAGAGAGCC | 5258 |
| TEE-249 | TGACATGCAAGAAATAAGGAAGTGCAAAAACAAAC AAACAAACAACAACAACAACAACAACAACAACAAC AAAAAACAGTCCCAAAAGGATGGGCAG | 5259 |
| TEE-250 | AGACTTGAAAAGCACAGACAACGAAAGCAAAAATG GACAAATGGAATCACATCAAGCTAAAAGGTTTTGCA TGGCAAAGG | 5260 |
| TEE-251 | GCAAAAGAAACAATCAGTAGAGTAAACAGACAACT CATAGAATGCAAGAAAATCATCGCAATCTGTACATC CAACAAAGGGCT | 5261 |
| TEE-252 | ACAAAATCAAACTAACCTCGATAAGAATGCAAGTGA ATCAAAATGAGTTTCAAGGGGTTGTGGCTAGTACAC GCTTTCTACAGCTG | 5262 |

TABLE 32-continued

TEE Sequences

| TEE Identifier | Sequence | SEQ ID NO |
|---|---|---|
| TEE-253 | ACAAACCACTGCTCAAGGAAATAAGGACACAAACA AATGGAACAACATTCCGTGCTCATGGATAGGAAGAA TCAATATCGTGAAAATGGCCATACT | 5263 |
| TEE-254 | GAACGATTTATCACTGAAAATTAATACTCATGCAAG TAGTAAACGAATGTAATGACCATGATAAGGAGACGG ACGGTGGTGATAGT | 5264 |
| TEE-255 | AGCAGAAGAAATAACTGAAATCAGAGTGAAACTGA ATCAAATTGAGATGCAAAATACATACGAAATGGCC AG | 5265 |
| TEE-256 | TGAATAGACACACAGACCAATGGAACAGAATAGAG AACACAGAATAAATCTGCACACTTATAGCCAGCTGA TTTTTGACAAATTTGCCAAG | 5266 |
| TEE-257 | AGCAACTTCAGCAGTCTCAGTATACAAAAACAATGT GCAAAAATCACAAGCATTCCTATATGCCAATAACAG ACAAACAGAGAGCC | 5267 |
| TEE-258 | ACCAATCAAGAAAACAATGCAACCCACAGAGAATG GACAAAAGCAAGGCAGGACAATGGCT | 5268 |
| TEE-259 | GCCACAATTTTGAAACAACCATAATAATGAGAATAC ACAAGACAACTCCAATAATGTGGGAAGACAAACTTT GCAATTCACATCATGGC | 5269 |
| TEE-260 | GAAAATGAACAATATGAACAAACAAACAAAATTACT ACCCTTACGAAAGTACGTGCATTCTAGTATGGTGAC AAAAAGGAAA | 5270 |
| TEE-261 | TATGCAAATCAATAAACATAATCCATCACATAAACA GAAACAAAGACAAAATGACATGATTATCTCAATAGA TGCAGAAAAGGCC | 5271 |
| TEE-262 | CACCCATCTGTAGGACCAGGAAGCCTGATGTGGGAG AGAACAGCAGGCTAAATCCAGGGTTGGTCTCTACAG CAGAGGGAATCACAAGCCTGTTAGCAAGTGAAGAAC CAACACTGGCAAGAGTGTGAAGGCC | 5272 |
| TEE-263 | AGGATACAAAATCAATGTACAAAAATCACAAACATT CTTATACACCAACAACAGACAAACAGAGAGCCAAAT CATGGGTG | 5273 |
| TEE-264 | AGGAAAATGCAAATCAGAACGACTATAACACACCAT CTCAAACTCGTTAGGATGGCTATTATCAAAAAGTCA AGAGATAACAAATGTGGGCAAGGG | 5274 |
| TEE-265 | GTAACAAAACAGACTCATAGACCAATAGAACAGAAT AGAGAATTCAGAAATAAGACTGCACTTCTATGACCA TGTGATCTTAGACAAACCT | 5275 |
| TEE-266 | AAAGGAAAACTACAAAACACTGCTGAAAGAAATCAT TGACAACACAAACAAATGGAAACACATCCCAAGATC ATGGGTGGGTGGAATCAAT | 5276 |
| TEE-267 | ACACACATACCAACAGAACATGACAAAAGAACAAA ACCAGCCGCATGCATACTCGATGGAGACAAAGGTAA CACTGCAGAATGGTGAAGGAAGAACAGTCATTTTAA TGACAGTGTTGGCT | 5277 |
| TEE-268 | AACTAAGACAACAGATTGATTTACACTACTATTTTCA CACAGCCAAAAATATCACTATGGCAATCGTCAAAAG GTCAATTCAAAGATGGGACAGT | 5278 |
| TEE-269 | GATCAGCTTAGAATACAATGGAACAGAACAGATTAG AACAATGTGATTTTATTAGGGGCCACAGCACTGTTG ACTCAAGTACAAGTTCTGACTCATGTAGAACTAACA CTTTT | 5279 |
| TEE-270 | GAATGGAATCAAATCGAATGAAATGGAATGGAATAG AAAGGAATGGAATGAAATGGAATGGAAAGGATTCG AAT | 5280 |

TABLE 32-continued

TEE Sequences

| TEE Identifier | Sequence | SEQ ID NO |
|---|---|---|
| TEE-271 | AAATGAACAAAACTAGAGGAATGACATTACCTGACT TCAAATTATACTACAGAGCTATAGTAACCAAAACAG CATGGTACAGGCAT | 5281 |
| TEE-272 | GGACAACATACACAAATCAGTCAAGATACATCATTT CAACAGAATGAAAGACAAAAACCATTTGATCACTTC AATCGATGATGAAAAAGCA | 5282 |
| TEE-273 | AACTTCAGCAAATTCTCAGGATACAAAATCAATGTG CAAAAACCACAAGCATTCCTATACACCAATAATAGA CAGTGAGCCAAAT | 5283 |
| TEE-274 | TATGACTTTCACAAATTACAGAAAAAGACACCCATT TGACAAGGGAACTGAAGGTGGTGAAGACATACTGGC AGGCTAC | 5284 |
| TEE-275 | AACAGCAATAGACACAAAGTCAGCACTTACAGTACA AAAACTAATGGCAAAAGCACATGAAGTGGGACAT | 5285 |
| TEE-276 | TGTAACACTGCAAACCATAAAAACCGTAGAAGAAAA CCTAGACAATACTATTCAGGACATAGGCATGGGCAA AGAC | 5286 |
| TEE-277 | GAAGAAGAAAAAACATGGATATACAATGTCAACAG AAATCAAGGAGAAACGGAATTTCACCAATCAATTTA GTGATCTGGGTT | 5287 |
| TEE-278 | AAAACACACAAACATACATGTGGATGCACATATAAA CATGCACATACACACACATAAATGCACAAACACA CTTAACAAGCACACATGCAAACAAACACATGG | 5288 |
| TEE-279 | TAGAAGGAATTTGATACATGCTCAGAAATACAGGCA AAGGAAGTAGGTGCCTGCCAGTGAACACAGGGGAA CTATGGCTCCTA | 5289 |
| TEE-280 | TGACTAAACAGAGTTGAACAAGAACAAAAAGCAAA TTTGCAGAAATGAAATACATACTAATTGAAAGTCCA TGGACAGGCTCAACAGATGATATAGATACAGCTAAA GAGATAATTAGTGAAATGGATCAG | 5290 |
| TEE-281 | AAGTAATAAGACTGAATTAGTAATACAAAGTGTCTC AACAAAGAAAATTGCGGGACTGTTCATGCTCATGGA CAGGAAGAATCAATATCATGAAAATGGCC | 5291 |
| TEE-282 | ACAGACAGAGATTTAAAACAATAAACAAGCAGTAA GCAAACACAGATAACAAAATGACATGATCCAACAAA TACTCAGAAGGAGACTTAGAAATGAATTGAGGGTC | 5292 |
| TEE-283 | AGAAAAAAACAAACAGCCCATTAAAAGGTAGACAA AGGACATGAACACTTTTCAAAAGAAGACATACATGT GGCCAAACAGCATG | 5293 |
| TEE-284 | AAAAATGACCAGAGCAATAGAATGCATTGACCAGAT AAAGACCTTCACGTATGTTGAACTAAAATGTGTGGT GCAGGTG | 5294 |
| TEE-285 | AATCAGTCTAGATCTTAAAGGAACACCAGAGGGAGT ATTTAAATGTGCCCAATAAGCAAGAATTATGGTGAT GTGGAAGTA | 5295 |
| TEE-286 | GAATGGAATGGAAAGGAATCGAAACGAAAGGAATG GAGACAGATGGAATGGAATGGAACAGAGAGCAATGG | 5296 |
| TEE-287 | GGAATGGAATGAACACGAATGTAATGCAACCCAATA GAATGGAATCGAATGGCATGGAATATAAAGAAATGG AATCGAAGAGAATGGAAACAAATGGAATGGAATTG | 5297 |
| TEE-288 | AGGACATGAATAGACAATTCTCAAAAGAAGATACAC AAGTGGCAAACAAACACATGAAAAAAGACTCAACA TTAGTAATGACCATGGAAATGCAAATC | 5298 |
| TEE-289 | TCCAGTCGATCATCATATAGTCAGCACTTATCATACA CCAAGCCGTGTGCAAGGAAAGGGAATACAACCATGA ACATGATAGATGGATGGTT | 5299 |

TABLE 32-continued

TEE Sequences

| TEE Identifier | Sequence | SEQ ID NO |
|---|---|---|
| TEE-290 | TACAGATAAGAAAATTGAGACTCAAGAGTATTACAT AAATTGTTTCAGCTACCACAGCAAAAAATGGTATGG TTGGGAATCAAGCTCAGGG | 5300 |
| TEE-291 | AGCCTATCAAAAAGTGGGCTAAGAATATGAATACAC AATTCTCAAAAGAAGATATACAAATGGGCAACAAAC ATATGAAAACATACTCAACATCACTAATGATCAGGG AAATG | 5301 |
| TEE-292 | GAAAATGAACAATATGAACAAACAAACAAAATTACT ACCCTTACGAAAGTACGTGCATTCTAGTATGGTGAC AAAAAGGAAAG | 5302 |
| TEE-293 | ACATACGCAAATCAATAAACATAATCCATCACATAA ACAGAACCAAAGACAAAAATCACATGATTATCTCAA TAGATGCAGAAAAGGCCTTCGAC | 5303 |
| TEE-294 | AAGAGTATCAACAGTAAATTACATTAGCAGAAGAAT CAACAAACATGAAAATAGAAATTATGGTAGCCAAAG AACAG | 5304 |
| TEE-295 | AATCGAATGGAATCAACATCAAACGGAAAAAAACG GAATTATCGAATGGAATCGAAGAGAATCATCGAATG GACC | 5305 |
| TEE-296 | GAAAGGAATAGAATGGAATGGATCGTTATGGAAAG ACATCGAATGGGATGGAATTGACTCGAATGGATTGG ACTGGAATGGAACGGACTCGAATGGAATGGACTGGA ATG | 5306 |
| TEE-297 | TAAGCAATTTCAGCAGTCTCAGGATACAAAATCAAT GTGCAAAAATCACAAGCATTCTTATACACCAACAAC AGACAAACAGAGAGCCAAATCG | 5307 |
| TEE-298 | AACGGAATCAAACGGAATTATCGAATGGAATCGAAG AGAATCATCGAATGGCCACGAATGGAATCATCTAAT GGAATGGAATGGAATAATCCATGGACCCGAATG | 5308 |
| TEE-299 | ACATCAAACGGAATCAAACGGAATTATCGAATGGAA TCGAAAAGAATCATCGAACGGACTCGAATGGAATCA TCTAATGGAATGGAATGGAAG | 5309 |
| TEE-300 | ATCGAATGGAATCAACATCAAACGGAAAAAAACGG AATTATCAAATGGAATCGAAGAGAATCATCGAATGG ACC | 5310 |
| TEE-301 | GAATAATCATTGAACGGAATCGAATGGAAACATCAT CGAATGGAAACGAATGGAATCATCATCGAATGGAAA TGAAAGGAGTCATC | 5311 |
| TEE-302 | CATCAAACGGAATCAAACGGAATTATCGAATGGAAT CGAAAAGAATCATCGAACGGACTCGAATGGAATCAT CTAATGGAATGGAATGGAAGAATCCATGGACTCGAA TG | 5312 |
| TEE-303 | AAACGGAATCAAACGGAATTATCGAATGGAATCGAA GAGAATCATCGAATGGACTCGAATGGAATCATCTAA TGGAATGGAATGGAAGAATCCATGG | 5313 |
| TEE-304 | ATACACAAATCAATAAATGTAATCCAGCATATAAAC AGAACCAAAGACAAAAACCATATGATTATCTCAATG GATGCAGAAAAGGCC | 5314 |
| TEE-305 | AATCGAATAGAATCATCGAATGGACTCGAATGGAAT CATCGAATGTAATGATGGAACAGTC | 5315 |
| TEE-306 | TGGAATGGAATCATCGCATAGAATCGAATGGAATTA CCATCGAATGGGATCGAATGGTATCAACATCAAACG CAAAAAAACGGAATTATCGAATGGAATCGAAGAGA ATCTTCGAACGGACCCG | 5316 |
| TEE-307 | ATGGAATGGAATGGAATGGAATTAAATGGAATGGAA AGGAATGGAATCGAATGGAAAGGAATC | 5317 |

TABLE 32-continued

TEE Sequences

| TEE Identifier | Sequence | SEQ ID NO |
|---|---|---|
| TEE-308 | GTCGAAATGAATAGAATGCAATCATCATCAAATGGA ATCCAATGGAATCATCATCAAATAGAATCGAATGGA ATCATCAAATGGAATCGAATGGAGTCATTG | 5318 |
| TEE-309 | TGGAATTATCGAAAGCAAACGAATAGAATCATCGAA TGGACTCGAATGGAATCATCGAATGGAATGGAATGG AACAG | 5319 |
| TEE-310 | AAAGGAATGGAATGCAATGGAATGCAATGGAATGC ACAGGAATGGAATGGAATGGAATGGAAAGGAATG | 5320 |
| TEE-311 | AATCTAATGGAATCAACATCAAACGGAAAAAAACGG AATTATCGAATGGAATCGAAGAGAATCATCGAATGG ACC | 5321 |
| TEE-312 | TACACAACAAAAGAAATACTCAACACAGTAAACAGA CAACCTTCAGAACAGGAGAAATATTTGCAAATACA TCTAACAAAGGGCTAATATCCAGAATCT | 5322 |
| TEE-313 | TGCAATCCTAGTCTCAGATAAAACAGACATTAAACC AACAAAGATCAAAAGAGACAAAGAAGGCCATTAC | 5323 |
| TEE-314 | GAATCGAATGGAATCAACATCAAACGGAAAAAAAC GGAATTATCGAATGGAATCGAAAAGAATCATCGAAT GGACC | 5324 |
| TEE-315 | AATGGAATCGAATGGAATGCAATCCAATGGAATGGA ATGCAATGCAATGGAATGGAATCGAACGGAATGCAG TGGAAGGGAATGG | 5325 |
| TEE-316 | GAACACAGAAAAATTTCAAAGGAATAATCAACAGG GATTGATAACTAACTGGATTTAGAGAGCCAAGGCAA AGAGAATCAAAGCACAGGGCCTGAGTCGGAG | 5326 |
| TEE-317 | AGTTGAATAGAACCAATCCGAATGAAATGGAATGGA ATGGAACGGAATGGAATTGAATGGAATGGAATGGA ATGCAATGGA | 5327 |
| TEE-318 | AACTCGATTGCAATGGAATGTAATGTAATGGAATGG AATGGAATTAAC GC GAATAGAATGGAAT GGAATGTA ATGGAACGGAATGGAATG | 5328 |
| TEE-319 | AAGCGGAATAGAATTGAATCATCATTGAATGGAATC GAGTAGAATCATTGAAATCGAATGGAATCATAGAAT GGAATCCAAT | 5329 |
| TEE-320 | AATGGAATCGAAAGGAATAGAATGGAATGGATCGTT ATGGAAAGATATCGAATGGAATGGAATTGACTCGAA TGGAATGGACTGGAATGGAACG | 5330 |
| TEE-321 | TAACGGAATAATCATCGAACAGAATCAAATGGAATC ATCATTGAATGGAATTGAATGGAATCTTCGAATAGA CATGAATGGACCATCATCG | 5331 |
| TEE-322 | AACGGAATCAAACGGAATTATCGAATGGAATCGAAT AGAATCATCGAACGGACTCGAATGGAATCATCTAAT GGAATGGAATGGAAG | 5332 |
| TEE-323 | ATTGGAATGGAACGGAACAGAACGGAATGGAATGG AATAGAATGGAATGGAATGGAATGGTATGGAATGGA ATGGAATGGTACG | 5333 |
| TEE-324 | AATCCACAAAGACAACAGAAGAAAAGACAACAGTA GACAAGGATGTCAACCACATTTTGGAAGAGACAAGT AATCAAACACATGGCA | 5334 |
| TEE-325 | GAATCGAATGGAATCAACATCAAACGGAAAAAAAC GGAATTATCGAATGGAATCGAAAAGAATCATCGAAC GGACTCGAATGGAATCATCTAATGGAATGGAATGGA AGAATCCATGG | 5335 |
| TEE-326 | AATGGAATCGAATGGAATCATCATCAAATGGAATCT AATGGAATCATTGAACGGAATTGGATGGAATCGTCAT | 5336 |

TABLE 32-continued

TEE Sequences

| TEE Identifier | Sequence | SEQ ID NO |
|---|---|---|
| TEE-327 | CAACATCAAACGGAAAAAAACGGAATTATCGAATGG AATCGAAGAGAATCATCGAATGGACC | 5337 |
| TEE-328 | CACAACCAAAGCAATGAAAGAAAAGCACAGACTTAT TGAAATGAAAGTACACACCACAGAATGGGAGCAGG CTCAAGCAAGC | 5338 |
| TEE-329 | ATCAAAGGGAATCAAGCGGAATTATCGAATGGAATC GAAGAGAATCATCGAATGGACTCGAATGGAATCATG TGATGGAATGGAATGGAATAATCCACGGACT | 5339 |
| TEE-330 | GGAATCGAATGGAATCAATATCAAACGGAGAAAAA CGGAATTATCGAATGGAATCGAAGAGAATCATCGAA TGGACC | 5340 |
| TEE-331 | AGGAATGGACACGAACGGAATGCAATCGAATGGAA TGGAATCTAATAGAAAGGAATTGAATGAAATGGACT GG | 5341 |
| TEE-332 | GGAAGGGAATCAAATGCAACAGAATGTAATGGAAT GGAATGCAATGGAATGCAATGGAATGGAATGGAATG CAATGGAATGG | 5342 |
| TEE-333 | AAATTGGATTGAATCGAATCGAATGGAAAAAATGAA ATCAAATGAAATTGAATGGAATCGAAATGAATGTAA ACAATGGAATCCAATGGAATCCAATGGAATCGAATC AAATGGTTTTGAGTGGCGTAAAATG | 5343 |
| TEE-334 | AATGGAAGGGAATGGAATGGAATCGAATCGAATGG AACAGAATTCAATGGAATGGAATGGAATGGAATGGA ATCGAATGGAATGG | 5344 |
| TEE-335 | GAAAAATCATTGAACGGAATCGAATGGAATCATCAT CGGATGGAAACGAATGGAATCATCATCGAATGGAAA TGAAAGGAGTCATC | 5345 |
| TEE-336 | GGAATCGAATGGAATCAACATCAAACGGAGAAAAA CGGAATTATCGAATGGAATCGAAGAGAATCATCGAA TGGACC | 5346 |
| TEE-337 | AAAGAAATGTCACTGCGTATACACACACACGCACAT ACACACACCATGGAATACTACTCAGCTATACAAAGG AATGAAATAATC CACAGC CAC | 5347 |
| TEE-338 | GGAATCGAATGGAATCAATATCAAACGGAAAAAAA CGGAATTATCGAATGGAATCGAAGAGAATCATCGAA TGGACC | 5348 |
| TEE-339 | TGAACGGAATCGAATGGAATCATCATCGGATGGAAA CGAATGGAATCATCATCGAATGGAAATGAAAGGAGT CATC | 5349 |
| TEE-340 | GAATAGAACGAAATGGAATGGAATGGAATGGAATG GAAAGGAATGGAATGGAATGGAACG | 5350 |
| TEE-341 | TGGAATTATCGTCGAATAGAATCGAATGGTATCAAC ATCAAACGGAAAAAAACGGAATTATCGAATGGAATC GAAGAGAATCATCGAACGGACTCGAATGGAATCATC TAATGGAATGGAATGGAATAATCCATGG | 5351 |
| TEE-342 | GACAAAAAGAATCATCATCGAATAGAATCAAATGGA ATCTTTGAATGGACTCAAAAGGAATATCGTCAAATG GAATCAAAAGCCATCATCGAATGGACTGAAATGGAA TTATCAAATGGACTCG | 5352 |
| TEE-343 | AACCAAACCAAGCAAACAAACAAACAGTAAAAACT CAATAACAACCAACAAACAGGAAATACCAGGTAATT CAGATTATCTAGTTATGTGCCATAGT | 5353 |
| TEE-344 | GAATGAATTGAATGCAAACATCGAATGGTCTCGAAT GGAATCATCTTCAAATGGAATGGAATGGAATCATCG CATAGAATCGAATGGAATTATCAACGAATGGAATCG AATGGAATCATCATCAGATGGAAATGAATGGAATCG TCAT | 5354 |

TABLE 32-continued

TEE Sequences

| TEE Identifier | Sequence | SEQ ID NO |
|---|---|---|
| TEE-345 | TGGAATGGAATCAAATCGCATGGAATCGAATGGAAT AGAAAAGAATCAAACAGAGTGGAATGGAATGGAAT GGAATGGAATCATGCCGAATGGAATG | 5355 |
| TEE-346 | AAATGGAATAATGAAATGGAATCGAACGGAATCATC ATCAAAAGGAACCGAATGAAGTCATTGAATGGAATC AAAGGCAATCATGGTCGAATGGAATCAAATGGAAAC AGCATTGAATAGAATTGAATGGAGTCATCACATGGA ATCG | 5356 |
| TEE-347 | GAATTAACCCGAATAGAATGGAATGGAATGGAATGG AACAGAACGGAACGGAATGGAATGGAATGGAATGG AATGGAATG | 5357 |
| TEE-348 | AAGATATACAAGCAGCCAACAAACATACGAAAGAA TGCTCAACATCACTAATCCTCAGAGAAATTTAAATCA AAACCACAATGAGTTACAATCTCATACCAGTCAGAAT | 5358 |
| TEE-349 | AGATAAGTGGATGAACAGATGGACAGATGGATGGAT GGATGGATGGATGGATGGATGCCTGGAAGAAAGAA GAATGGATAGTAAGCTGGGTATA | 5359 |
| TEE-350 | AGAATTACAAACCACTGCTCAACAAAATAAAAGAGT ACACAAACAAATGGAAGAATATTCCATGCTTATGGA TAGGAAGAATCAATATTGTGAAAATGGCCATACT | 5360 |
| TEE-351 | CATCGAATGGACTCGAATGGAATAATCATTGAACGG AATCGAAGGGAATCATCATCGGATGGAAACGAATGG AATCATCATCGAATGGAAATG | 5361 |
| TEE-352 | AAAGGAATCAAACGGAATTATCGAATGGAATCGAAA AGAATCATCGAACGGACTCGAATGGAATCATCTAAT GGAATGGAATGGAAGAATCCATGGACTCGAATG | 5362 |
| TEE-353 | GGATATAAACAAGAAAACAACTAATCACAACTCAAT ATCAAAGTGCAATGATGGTGCAAAATGCAAGTATGG TGGGGACAGAGAAAGGATGC | 5363 |
| TEE-354 | AACATCAAACGGAAAAAAACGGAAATATCGAATGG AATCGAAGAGAATCATCGAATGGACC | 5364 |
| TEE-355 | TAAAATGGAATCGAATGGAATCAACATCAAATGGAA TCAAATGGAATCATTGAACGGAATTGAATGGAATCG TCAT | 5365 |
| TEE-356 | AATCATCATCGAATGGAATCGAATGGTATCATTGAA TGGAATCGAATGGAATCATCATCAGATGGAAATGAA TGGAATCGTCAT | 5366 |
| TEE-357 | CAATGCGTCAAGCTCAGACGTGCCTCACTACGGCAA TGCGTCAAGCTCAGGCGTGCCTCACTAT | 5367 |
| TEE-358 | TAAGCTGATAAGCAACTTTAGCAAAGTCTCAGGATA CAAAATCAATGTACAAAAATCACAAGCATTCTTATA CACCAACAACAGACAGACGGAGAGCCAAA | 5368 |
| TEE-359 | AATCAAAGAATTGAATCGAATGGAATCATCTAATGT ACTCGAATGGAATCACCAT | 5369 |
| TEE-360 | ATGAACACGAATGTAATGCAATCCAATAGAATGGAA TCGAATGGCATGGAATATAAAGAAATGGAATCGAAG AGAATGGAAACAAATGGAATGGAATTGAATGGAAT GGAATTG | 5370 |
| TEE-361 | ATCAAACGGAATCAAACGGAATTATCGAATGGAATC GAAGAGAATCATCGAACGGACTCGAATGGAATCATC TAATGGAATGGGATGG | 5371 |
| TEE-362 | AATGGAAAGGAATCAAATGGAATATAATGGAATGCA ATGGACTCGAATGGAATGGAATGGAATGGACCCAAA TGGAATGGAATGGAATGGAATG | 5372 |
| TEE-363 | GGAATACAACGGAATGGAATCGAAAAAAATGGAAA GGAATGAAATGAATGGAATGGAATGGAATGGAATG GATGGGAATGGAATGGAATGGAATGG | 5373 |

TABLE 32-continued

TEE Sequences

| TEE Identifier | Sequence | SEQ ID NO |
|---|---|---|
| TEE-364 | GAATCAAGCGGAATTATCGAATGGAATCGAAGAGAA TCATCGAAAGGACTCGAATGGAATCATCTAATGGAA TGGAATGGAATAATACACGGACC | 5374 |
| TEE-365 | AAGATAACCTGTGCCCAGGAGAAAAACAATCAATGG CAACAAAAGCAGAAACAACACAAATGATACAATTA GCAGACAGAAACATTGAGATTGCTATT | 5375 |
| TEE-366 | AATGGACTCCAATGGAATAATCATTGAACGGAATCT AATGGAATCATCATCGGATGGAAATGAGTGGAATCA TCATCGAATGGAATCG | 5376 |
| TEE-367 | AATCTATAAACGTAATCCATCACATAAACAGGACCA AAGAGAAAAACCGCATGATTATCTCAAGAATGCAGA AAAGGCC | 5377 |
| TEE-368 | TAATTGATTCGAAATTAATGGAATTGAATGGAATGC AATCAAATGGAATGGAATGTAATGCAATGGAATGTA ATAGAATGGAAAGCAATGGAATG | 5378 |
| TEE-369 | AAAGGAATGGACTTGAACAAAATGAAATCGAACGAT AGGAATCGTACAGAACGGAAAGAAATGGAACGGAA TGGAATG | 5379 |
| TEE-370 | TGAGCAGGGAACAATGCGGATAAATTTCACAAATAC AATGTTGAGCAAAAGAAAGACACAAAAGAATACAC ACATACACACCATATGGGCTAGG | 5380 |
| TEE-371 | AATGGAATCGAACGAATCATCATCAAACGGAACCG AATGGAATCATTGAATGGAATCAAAGGCAATCATGG TCGAATG | 5381 |
| TEE-372 | AATGGAATGGAATGTACAAGAAAGGAATGGAATGA AACCGAATGGAATGGACGCAAAATGAATGG AATGGAAGTCAATGG | 5382 |
| TEE-373 | AACGGAAAAAAACGGAATTATCGAATGGAATCGAA GAGAATCATCGAATGGACC | 5383 |
| TEE-374 | GGAATAATCATTGAACGGAATCGAATGGAATCATCA TCGGATGGAAACGAATGGAATCATCATCGAATGGAA ATGAAAGGAGTCATC | 5384 |
| TEE-375 | GGAACGAAATCGAATGGAACGGAATAGAATAGACT CGAATGTAATGGATTGCTATGTAATTGATTCGAATGG AATGGAATCG | 5385 |
| TEE-376 | TGAAAGGAATAGACTGGAACAAAATGAAATCGAAT GGTAGGAATCATACAGAACAGAAAGAAATGGAACG GAATGGAATG | 5386 |
| TEE-377 | AACCCGAATAGAATGGAATGGAATGGAATGGAACG GAACGGAATGGAATGGAATGGATTGGAATGGAATG GAATG | 5387 |
| TEE-378 | AAAGAGAATCAAATGGAATTGAATCGAATGGAATCG AATGGATTGGAAAGGAATAGAATGGAATGGAATGG AATGGAATGGAATGGAATG | 5388 |
| TEE-379 | AATGGAATCATCAGTAATGGAATGGAAAGGAATGGA AAGGACTGGAATGGAATGGAATGGAATGGAATGG | 5389 |
| TEE-380 | GGAACAAAATGAAATCGAACGGTAGGAATCGTACA GAACGGAAAGAAATGGAACGGAATGGAATGCACTC AAATGGAAAGGAGTCCAATGGAATCGAAAGGAATA GAATGGAATGG | 5390 |
| TEE-381 | AGAATGAGATCAAGCAGTATAATAAAGGAAGAAGT AGCAAAATTACAACAGAGCAGTGAAATGGATATGCT TTCTGGCAATAATTGTGAAAGGTCTGGTAATGAGAA AGTAGCAACAGCTAGTGGCTGC CAC | 5391 |

TABLE 32-continued

TEE Sequences

| TEE Identifier | Sequence | SEQ ID NO |
|---|---|---|
| TEE-382 | AACAAATGGAATCAACATCGAATGGAATCGAATGGA AACACCATCGAATTGAAACGAATGGAATTATCATGA AATTGAAATGGATGGACTCATCATCG | 5392 |
| TEE-383 | TAACATGCAGCATGCACACACGAATACACAACACAC AAACATGTATGCACGCACACGTGAATACACAACACA CACAAACATGCATGCATGCATACATGAATACACAGC ACACAAATATCCAGCAT | 5393 |
| TEE-384 | GAATGGAATCAACATCAAACGGAAAAAAAACGGAA TTATCGAATGGAATCGAATAGAATCATCGAATGGACC | 5394 |
| TEE-385 | AATCGAATGAAATGGAGTCAAAAGGAATGGAATCG AATGGCAAGAAATCGAATGTAATGGAATCGCAAGGA ATTGATGTGAACGGAACGGAATGGAAT | 5395 |
| TEE-386 | AATGGAATTGAACGGAAACATCAGCGAATGGAATCG AAAGGAATCATCATGGAATAGATTCGAATGGAATGG AAAGGAATGGAATGGAATG | 5396 |
| TEE-387 | ATGGAATCAACATCAAACAGAATCAAACGGAATTAT CGAATGGAATCGAAGACAATCATCGAATGGACTCGA ATGGAATCATCTAATGGAATGGAATGGAAGAATCCA TGGTCTCGAATGCAATCATCATCG | 5397 |
| TEE-388 | GAATAATCATTGAACGGAATCGAATGGAATCATCTT CGGATGGAAACGAATGGAATCATCATCGAATGGAAA TGAAAGGAGTCATC | 5398 |
| TEE-389 | AATGGACTCGAATGGAATAATCATTGAACGGAATCG AATGGAATCATCATCGGATGGAAATGAGTGGAATCA TCATCGAATGGAATCG | 5399 |
| TEE-390 | AAATGAAATCGAACGGTAGGAATCGTACAGAACGG AAAGAAATGGAACGGAATGGAATGCAATCGAATGG AAAGGAGTCCAATGGAAGGGAATCGAAT | 5400 |
| TEE-391 | TACCAAACATTTAAAGAACAAATATCAATCCTACGC AAACCATTCTGAAACACAGAGATGGAGGATATACAG CGAAACTCATTCTACATGGCC | 5401 |
| TEE-392 | TATTGGAATGGAATGGAATGGAGTCGAATGGAACGG AATGCACTCGAATGGAAGGCAATGCAATGGAATGCA CTCAACAGGAATAGAATGGAATGGAATGGAATGG | 5402 |
| TEE-393 | GGAATTTAATAGAATGTACCCGAATGGAACGGAATG GAATGGAATTGTATGGCATGGAATGGAA | 5403 |
| TEE-394 | GCAATCCAATAGAATGGAATCGAATGGCATGGAATA TAAAGAAATGGAATCGAAGAGAATGGAGACAAATG GAATGGAATTGAATGGAATGGAATTG | 5404 |
| TEE-395 | AATGGAATCGAATGGAATCATCATCAAATGGAATCT AATGGAATCATTGAACGGAATTAAATGGAATCGTCA TCGAATGAATTCAATGCAATCAACGAATGGTCTCGA ATGGAACCAC | 5405 |
| TEE-396 | AATTGCAAAAGAAACACACATATACACATATAAAAC TCAAGAAAGACAAAACTAACCTATGGTGATAGAAAT CAGAAAAGTACAGTACATTGGTTGTCTTGGTGGG | 5406 |
| TEE-397 | TGACATCATTATTATCAAGAAACATTCTTACCACTGT TACCAACTTCCCAACACAGACTATGGAGAGAGAGAT AAGACAGAATAGCATT | 5407 |
| TEE-398 | AAAGAATTGAATTGAATAGAATCACCAATGAATTGA ATCGAATGGAATCGTCATCGAATGGAATCGAAGGGA ATCATTGGATGGGCTCA | 5408 |
| TEE-399 | ATCATCGAATGGAATCGAATGGAATCAATATCAAAC GGAAAAAAACGGAATTATCGAATGGAATCGAATAG AATCATCGAATGGACC | 5409 |

TABLE 32-continued

TEE Sequences

| TEE Identifier | Sequence | SEQ ID NO |
|---|---|---|
| TEE-400 | GAATGAAATCGTATAGAATCATCGAATGCAACTGAA TGGAATCATTAAATGGACTTGAAAGGAATTATTATG GAATGGAATTG | 5410 |
| TEE-401 | TAAGCAACTTCAGCAAAGTCTCAGGATACAAAATCA ATGTGCAAAAATCTCAAGCATTCTTATACACGAACA ACAGACAAACAGAGAGCT | 5411 |
| TEE-402 | ACTCAAAAGGAATTGATTCGAATGGAATAGAATGGC AAGGAATAGTATTGAATTGAATGGAATGGAATGGAC CCAAATG | 5412 |
| TEE-403 | GAATGGAATTTAAAGGAATAGAATGGAAGGAATCG GATGGAATGGAATGGAATAGAATGGAGTCGAATGG AATAGAATCGAATGGAATGGCATTG | 5413 |
| TEE-404 | TGAGAAAATGATGGAAAAGAGGAATAAAACGAAAC AAAACCACAGGAACACAGGTGCATGTGAATGTGCAC AGACAAAGATACAGGGCGGACTGGAAGGAAGTTT CTGCACCAGAATTTGGGG | 5414 |
| TEE-405 | AACAAAAAATGAGTCAAGCCTTAAATAAAATCAGAG CCAAAAAAGAAGACATTACATCTGATAAGACAAAAA TTCAAAGGACCATC | 5415 |
| TEE-406 | AACCCAGTGGAATTGAATTGAATGGAATTGAATGGA ATGGAAAGAATCAATCCGAGTCGAATGGAATGGTAT GGAATGGAATGGCATGGAATCAAC | 5416 |
| TEE-407 | ATCAACATCAAACGGAAAAAAAACGGAATTATCGAA TGGAATCGAAGAGAATCATCGAATGGACC | 5417 |
| TEE-408 | AAGGAATGGAATGGTACGGAATAGAATGGAATGGA AC GAATTGTAATGGAATGGAATTTAATGGAAC GGAA TGGAATGGAATGGAATCAACG | 5418 |
| TEE-409 | AACGGAATGGAAAGCAATTTAATCAAATGCAATACA GTGGAATTGAAGGGAATGGAATGGAATGGC | 5419 |
| TEE-410 | AATCGAATGGAACGGAATAGAATAGACTCGAATGTA ATGGATTGCTATGTAATTGATTCGAATGGAATGGAA TCGAATGGAATGCAATCCAATGGAATGGAATGCAAT GCAATGGAATGGAATCGAACGGAATGCAGTGGAAG GGAATGG | 5420 |
| TEE-411 | TAGCAACATTTTAGTAACATGATAGAAACAAAACAG CAACATAGCAATGCAATAGTAACACAACAGCAACAT CATAACATGGCAGCA | 5421 |
| TEE-412 | AATGGAATCGAAGAGAATGGAAACAAATGGAATGG AATTGAATGGAATGGAATTGAATGGAATGGGAAGGA ATGGAGTG | 5422 |
| TEE-413 | AGCAAACAAGTGAATAAACAAGCAAACAAGTGAAC AAGCAAACAAGTGAATAAACAAGCAAACAAGTGAA CAAGCAAACAAGTGAATAAACAAGCAAACAAGT GA ACAAGGAAACAAGTGAATAAACAAAGGCTCT | 5423 |
| TEE-414 | AATGGAATCAACACGAGTGCAATTGAATGGAATCGA ATGGAATGGAATGGAATGGAATGAATTCAACCCGAA TGGAATGGAAAGGAATGGAATC | 5424 |
| TEE-415 | GAATCGAATGGAATCAACATCAAACGGAAAAAAAC GGAATTATCGAATGGAATCGAAGAGAATCATCGAAT GGACC | 5425 |
| TEE-416 | AACACGAATGTAATGCAATCCAATAGAATGGAATCG AATGGCATGGAATATAAAGAAATGGAATCGAAGAG AATGGAAACAACGAATGGAATTGAATGGAATGG AATTGAATGGAATGGGAACGAATGGAGTGAAATTG | 5426 |
| TEE-417 | GAATGGAACGGAATAGAACAGACTCGAATGTAATGG ATTGCTATGTAATTGATTCGAATGGAATGGAATCGA ATGGAATGCAATCCAATGGAATGGAATGCAATGCAA | 5427 |

TABLE 32-continued

TEE Sequences

| TEE Identifier | Sequence | SEQ ID NO |
|---|---|---|
| | TGGAATGGAATCGAATGGAATGCAGTGGAAGGGAAT<br>GG | |
| TEE-418 | GAATCGAATGGAATCAATATCAAACGGAAAAAAAC<br>GGAATTATCGAATGGAATCGAAGAGAATCATCGAAT<br>GGACC | 5428 |
| TEE-419 | ATAAACATCAAACGGAATCAAACGGAATTATCGAAT<br>GGAATCGAAGAGAATAATCGAATGGACTCAAATGGA<br>GTCATCTAATGGAATGGTATGGAAGAATCCATGGAC<br>TCCAACGCAATCATCAGCGAATGGAATC | 5429 |
| TEE-420 | AAAGAAAAGACAAAAGACACCAATTGCCAATACT<br>GAAATGAAAAACAGGTAATAACTATTGATCCCATG<br>GACATTAAAATGATGTTGAAGGAACACCAC | 5430 |
| TEE-421 | AATGTCAAGTGGAATCGAGTGGAATCATCGAAAGAA<br>ATCGAATGGAATCGAAGGGAATCATTGGATGGGCTC<br>AAAT | 5431 |
| TEE-422 | ATCATCGAATGGAATAGAATGGTATCAACATCAAAC<br>GGAGAAAAACGGAATTATCGAATGGAATCGAAGAG<br>AATCTTCGAACGGACC | 5432 |
| TEE-423 | GAATGGAATCATCGCATAGAATCGGATGGAATTATC<br>ATCGAATGGAATCGAATGGTATCAACATCAAACGGA<br>AAAAAACGGAATTATCGAATGGAATCGAATTGAATC<br>ATCGAACGGACCCG | 5433 |
| TEE-424 | AATGGACTCGAATGGAATAATCATTGAACGGAATCG<br>AATGGAATCATCATCGGATGGAAATGAATGGAATAA<br>TCCATGGACTCGAATGCAATCATCATCGAATGGAAT<br>CGAATGGAATCATCGAATGGACTCG | 5434 |
| TEE-425 | AATGCAATCATCAACTGGCTTCGAATGGAATCATCA<br>AGAATGGAATCGAATGGAATCATCGAATGGACTC | 5435 |
| TEE-426 | AAGAGACCAATAAGGAATAAGTAAGCAACAAGAGG<br>AAGGAGAAAAGGGCAAGAGAGATGACCAGAGTT | 5436 |
| TEE-427 | TGGAATCATCATAAAATGGAATCGAATGGAATCAAC<br>ATCAAATGGAATCAAATGGAATCATTGAACGGAATT<br>GAATGGAATCGTCAT | 5437 |
| TEE-428 | GGAATCATCGCATAGAATCGAATGGAATTATCATCG<br>AATGGAATCGAATGGAATCAACATCAAACGAAAAA<br>AAACCGGAATTATCGAATGGAATCGAAGAGAATCAT<br>CGAACGGACC | 5438 |
| TEE-429 | AAATCATCATCGAATGGGATCGAATGGTATCCTTGA<br>ATGGAATCGAATGGAATCATCATCAGATGGAAATGA<br>ATGGAATCGTCAT | 5439 |
| TEE-430 | GGAATGTAATAGAACGGAAAGCAATGGAATGGAAC<br>GCACTGGATTCGAGTGCAATGGAATCTATTGGAATG<br>GAATCGAATGGAATGGTTTGGCATGGAATGGAC | 5440 |
| TEE-431 | AAACAATGGAAGATAATGGAAAGATATCGAATGGA<br>ATAGAATGGAATGGAATGGACTCAAATGGAATGGAC<br>TTTAATGGAATGG | 5441 |
| TEE-432 | GGAACGAAATCGAATGGAACGGAATAGAATAGACT<br>CGAATGTAATGGATTGCTATGTAATTGATTCGAATGG<br>AATGGAATCGAATGGAATGCAATCCAATGGAATGGA<br>ATGCAATGCAATGAATGGAATGGAATGGAATGGAAT<br>GGAA | 5442 |
| TEE-433 | AAACCGAATGGAATGGAATGGACGCAAAATGAATG<br>GAATGGAAGTCAATGGACTCGAAATGAATGGAATGG<br>AATGGAATGGAATG | 5443 |
| TEE-434 | GGAATCGAATGGAATCAACATCAAACGGAAAAAAA<br>CAGAATTATCGTATGGAATCGAATAGAATCATCGAA<br>TGGACC | 5444 |

TABLE 32-continued

TEE Sequences

| TEE Identifier | Sequence | SEQ ID NO |
|---|---|---|
| TEE-435 | CAACCCGAGTGGAATAAAATGGAATGGAATGGAATG AAATGGAATGGATCGGAATGGAATCCAATGGAATCA ACTGGAATGGAATGGAATGGAATG | 5445 |
| TEE-436 | TATCATCGAATGGAATCGAATGGAATCAACATCAAA CGGAAAAAAACGGAATTATCGAATGGAATCGAAGA GAATCATCGAATGGACC | 5446 |
| TEE-437 | CGGAATAATCATTGAACGGAATCGAATGGAATCATC ATCGGATGGAAACGAATGGAATCATCATCGAATGGA AATGAAAGGAGTCATC | 5447 |
| TEE-438 | CAACACACAGAGATTAAAACAAACAAACAAACAAT CCAGCCCTGACATTTATGAGTTTACAGACTGGTGGA GAGGCAGAGAAG | 5448 |
| TEE-439 | CACTACAAACCACGCTCAAGGCAATAAAAGAACACA AACAAATGGAAAAACATTCCATGCTCATGGATGGG | 5449 |
| TEE-440 | AATCGAATGGAATTAACATCAAACGGAAAAAAACG GAATTATCGAATGGAATCGAAGAGAATCATCGAATG GACC | 5450 |
| TEE-441 | TGGAAAAGAATCAAATTGAATGGCATCGAACGGAAT GGGATGGAATGGAATAGACCCAGATGTAATGGACTC GAATGGAATG | 5451 |
| TEE-442 | GACTAATATTCAGAATATACAAGGAACTCAAACAAC TCAACAGTAGAAAAAAAACCTGAATAGACATTTCT CAAAAGAAGACATACAAATGGCC | 5452 |
| TEE-443 | GGTCCATTCGATGATTCTCTTCGATTCCATTCGATAA TTCCGTTTTTTCCCGTTTGATGTTGATTCC | 5453 |
| TEE-444 | GGAACGAAATCGAATGGAACGGAATAGAATAGACT CGAATGTAATGGATTGCTATGTAATTGATTCGAATGG AATGGAATCGAATGGAATGCAATCCAATGGAATGGA ATGCAATGCAATGAATGGAATGGAATGGAATGGAAT GGA | 5454 |
| TEE-445 | AGCAACTTCAGTAAAGTGTCAGGATACAAAATCAAT GTGCAAAAATCACAAGCATTCTTATACATCAATAAC AGACAAACAGAGAGCCAAA | 5455 |
| TEE-446 | GAATAATCATTGAACGGAATCGAATGGAATCATCAT CGGATGGAAACGAATGGAATCATCATCGAATGGAAA TGAAAGGAGTCATC | 5456 |
| TEE-447 | TAATCATCTTCGAATTGAAAACAAAGCAATCATTAA ATGTACTCTAACGGAATCATCGAATGGACC | 5457 |
| TEE-448 | GGAATCGAATGGAATCAACATCAAACGGAAAAAAA CGGAATTATCGAATGGAATCGAAGAGAATCATCGAA TGGACC | 5458 |
| TEE-449 | AGAGAAAAGATGATCATGTAACCATTGAAAAGACAA TGTACAAAACTAATACTAATCACACAGGACCAGAAA GCAATTTAGAC CAT | 5459 |
| TEE-450 | AATGGAATCGAATGGAATCAACATCAAACGGAAAA AACGGAATTATCGAATGGAATCAAGAGAATCATCG AATGGACC | 5460 |
| TEE-451 | AATGGAATTATCATCGAATGGAATCGAATGGAATCA ACATCAAACGGAAAAAAACGGAATTATCGAATGGA ATCGAAGAGAATCATCGAATGGACC | 5461 |
| TEE-452 | GTCAACACAGGACCAACATAGGACCAACACAGGGTC AACACAGGACCAACATAGGACCAACACAGGGTCAA CACAAGACCAACATGGGACCAACACAGGGTCAACAT AGGACCAACATGGGACCAACACAGGGTCAACACAG GACCAAC | 5462 |

TABLE 32-continued

TEE Sequences

| TEE Identifier | Sequence | SEQ ID NO |
| --- | --- | --- |
| TEE-453 | GAATCAACTCGATTGCAATCGAATGGAATGGAATGG TATTAACAGAATAGAATGGAATGGAATGGAATGGAA CGGAACG | 5463 |
| TEE-454 | ACTCGAATGCAATCAACATCAAACGGAATCAAACGG AATTATCGAATGGAATCGAAGAGAATCATCGAACGG ACTCGAATGGAATCATCTAATGGAATGGAATGG | 5464 |
| TEE-455 | AATGGAATGGAATAATCGACGGACCCGAATGCAATC ATCATCGTACAGAATCGAATGGAATCATCGAATGGA CTGGAATGGAATGG | 5465 |
| TEE-456 | AATACAAACCACTGCTCAACGAAATAAAAGAGGATA CAAACAAATGGAAGAACATTCTATGCTCATGGGTAG GATGAATTCATATCGTGAAAATGGCCATACTGCC | 5466 |
| TEE-457 | AAACACGCAAACACACACACAAGCACACTACCACAC AAGCGGACACACATGCAAACACGCGAACACACACA CATATACACACAAGCACATTACAAAACACAAGCAAA CACCAGCAGACACACAAACACACAAACATACATGG | 5467 |
| TEE-458 | AATCGAACGGAATCAACATCAAACGGAAAAAAAAC GGAATTATCGAATGGAATCGAAGAGAATCATCGAAT GGACC | 5468 |
| TEE-459 | TAATTGATTCGAATGGAATGGAATAGAATGGAATTG AATGGAATGGACCATAATGGATTGGACTTTAATAGA AAGGGCATG | 5469 |
| TEE-460 | AGCAACTTCAGCAAAGTCTCAGGATACAAAATCAAT GTACAAAAGTCACAAGCATTCTTATACACCAACAAA AGACAAACAGAGAGCC | 5470 |
| TEE-461 | ACATCAAACGGAAAAAAAAAACAAACGGAATTAT CGAATGGAATCGAAGAGAATCATCGAATGGACC | 5471 |
| TEE-462 | GAAATTCCAATTAAAATGAAATCGACTTATCTTAAC AAAATATAGCAATGCTGACAACACTTCTCCGGATATG GGTACTGCT | 5472 |
| TEE-463 | ACATCTCACTTTTAGTAATGAACAGATCATTCAGACA GAAAATTAGCAAAGAAACATCAGAGTTAAACTACAC TCTAAACCAAATGGACCTA | 5473 |
| TEE-464 | GAAGAAAGCATTCATTCAAGACATCTAACTCGTTGA TATAATGCATACAGTTCAAAATGATTACACTATCATT ACATCTAGGGCTTTC | 5474 |
| TEE-465 | ACACACACATTCAAAGCAGCAATATTTACAACAGCC AAAAGGTGGAAACAATTGAGCAATTG | 5475 |
| TEE-466 | ATCATCGAATAGAATCGAATGGTATCAACACCAAAC GGAAAAAAACGGAATTATCGAATGGAATCGAAGAG AATCTTCGAACGGACC | 5476 |
| TEE-467 | ATCAACATCAAACGGAAAAAACGGAATTATCGAATG GAATCGAAGAGAATCATCGAACGGACC | 5477 |
| TEE-468 | AATCGAAAGGAATGTCATCGAATGGAATGGACTCAA ATGGAATAGAATCGGATGGAATGGCATCGAATGGAA TGGAATGGAATTGGATGGAC | 5478 |
| TEE-469 | AACATGAACAGTGGAACAATCAGTGAACCAATACAA GGGTTAAATAAGCTAGCAATTAAAAGCTGTATCACT GGTCTAAAGATAGAAGATCAAGTAGAAAATCAGCGC AAGAGGAAAGATATACGAAAACTAATGGCC | 5479 |
| TEE-470 | CGAATGGAATCATTATGGAATGGAATGAAATGGAAT AATCAAATGGAATTGAATGGAATCATCGAATGGAAT CGAACAAAATCCTCTTTGAATGGAATAAGATGGAAT CACCAAATGGAATTG | 5480 |

TABLE 32-continued

TEE Sequences

| TEE Identifier | Sequence | SEQ ID NO |
|---|---|---|
| TEE-471 | AAGGGAATTGAATAGAATGAATCCGAATGGAATGGA ATGGAATGGAATGGAATGGAATGGAATGGAATGGA ATGGAATG | 5481 |
| TEE-472 | GAATGGAATCGAATCAAATTAAATCAAATGGAATGC AATAGAAGGGAATACAATGGAATAGAATGGAATGG AATGGAATGGACT | 5482 |
| TEE-473 | AAACGGAATCAAACGGAATTATCGAATGGAATCGAA GAGAATCATCGAACGGACTCGAATGGAATCATCTAA TGGAATGGAATGGAAGAATCCATGGACT | 5483 |
| TEE-474 | ATGGAATCAACATCAAACGGAAAAAAAAACGGAAT TATCGAATGGAATCGAAGAGAATCATCGAATGGACC AGAATGGAATCATCTAATGGAATGGAATGG | 5484 |
| TEE-475 | AATGGAATCATCATCGAATGGAATCGAATGGAATCA TGGAATGGAATCAAATGGAATCAAATGGAATCGAAT GGAATGGAATGGAATG | 5485 |
| TEE-476 | AACGGAATCAAACGGAATTACCGAATGGAATCGAAT AGAATCATCGAACGGACTCGAATGGAATCATCTAAT GGAATGGAATGGAAG | 5486 |
| TEE-477 | AAACGGAATCAAACGGAATTATCGAATGGAATCGAA AAGAATCATCGAACGGACTCGAATGGAATCATCTAA TGGAATGGAATGGAAGAATCCATGG | 5487 |
| TEE-478 | GAATGATACGGAATACAATGGAATGGAACGAAATG AAATGGAATGGAATGGAATGGAATGGAATGGAATGG | 5488 |
| TEE-479 | ACAGCAAGAGAGAAATAAAACGACAAGAAAACTAC AAAATGCCTATCAATAGTTACTTTAAATATCAGTGGA CCAAATCAGTGAAACAAAAGACACAGAGTGGC | 5489 |
| TEE-480 | AATGGACTCGAATGGATTAATCATTGAACGGAATCG AATGGAATCATCATCGGATGGTAATGAATGGAATCA TCATCGAATGGAATCGG | 5490 |
| TEE-481 | GAATGGAATCGAAAGGAATGTCATCGAATGGAATGG AATGGAACGGAATGGAATC GAATGGAATGGACTC GA ATGGAATAGAATCGAATGCAATGGCATCG | 5491 |
| TEE-482 | ATCGAATGGAATCAACATCAGACGGAAAAAAACGG AATTATCAAATGGAATCGAAGAGAATCATCGAATGG ACC | 5492 |
| TEE-483 | AGCAACTTCAGCAAAGTCTCAGGATACAAAATCAAT GTGCAAAAATCAAAAGCATTCTTATGCACCAATAAC AGACACAGAGCCAAAT | 5493 |
| TEE-484 | AATGGAATGGAACGCAATTGAATGGAATGGAATGGA ACGGAATCAACCTGAGTCAAATGGAATGGAATGGAA TGGAATG | 5494 |
| TEE-485 | GGAACGAAATCGAATGGAACGGAATAGAATAGACT CGAATGTCATGGATTGCTATGTAATTGATTGGAATGG AATGGAATCG | 5495 |
| TEE-486 | TAGCAGGAAACAGCAAACTCAAATTAAGTAATTTCA AGAGCGTATCATCAATGAACTATTTTCAAAGATGTG GGCAAGAT | 5496 |
| TEE-487 | GAATTGAAAGGAATGTATTGGAATAAAATGGAATCG AATAGGTTGAAATACCATAGGTTCGAATTGAATGGA ATGGGAGGGACACCAATGGAATTG | 5497 |
| TEE-488 | AAGCAACTTCAGCAAAGTCTCGGGATACAAAATCAA TGTGCAAAAATCACAAGCATTCTTATACACCACTAA CAGACAAATGGAGAGTC | 5498 |
| TEE-489 | GAATGGAATCAACATCAAACGGAAAAAAACGGAAT TATCGAATGGAATCGAAGAGAATCATCGAATGGACC | 5499 |

TABLE 32-continued

TEE Sequences

| TEE Identifier | Sequence | SEQ ID NO |
|---|---|---|
| | AGAATGGAATCATCTAATGGAATGGAATGGAATAAT CCATGG | |
| TEE-490 | AAAAGCAATTGGACTGATTTTAAATATACGTGGCAA CAAGGATAAACTGCTAATGATGGGTTTGCAAATACA GATCG | 5500 |
| TEE-491 | AATGGAATCAACATCGAACGGAAAAAAACGGAATT ATCGAATGGAATCGAAGAGAATCATCGAATGGACC | 5501 |
| TEE-492 | AAACGGAATTATCAAATGGAATCGAAGAGAATCATC GAACGGACTCGAATGGAATCATCTAATGGAATGGAA TGGAAG | 5502 |
| TEE-493 | TGCAAGATAACACATTTTAGTTGACACCATTGAAAA CAGTTTTAACCAAGAATATTAGAACCAATGAAGCAG AGAAATCAAAAGGGTGGATGGAACTGCCAAAGGATG | 5503 |
| TEE-494 | TAGAACAGAATTGAATGGAATGGCATCAAATGGAAT GGAAACGAAGGAATGGAATTGAATGGACTCAAAT GTTATGGAATCAAAGGGAATGGACTC | 5504 |
| TEE-495 | AAGAGAATCATCGAATGGAATCGAATGGAATCAACA TCAAACGGAAAAAAACGGAATTATCGAATGGAATCG AAGAGAATCATCGAATGGACC | 5505 |
| TEE-496 | ATCAACATCAAACGGAAAAAAACGGAATTATCGAAT GGAATCGAAGAGAATCATCGAATGGACC | 5506 |
| TEE-497 | GAATCAACATCAAACGGAAAAAAACCGAATTATCGA ATGGAATCGAAGAGAATCATCGAATGGACC | 5507 |
| TEE-498 | ATCAACATCAAACGGAATCAAACGGAATTATCGAAT GGAATCGAAGAGAATCATCAAATGGACTCGAATGGA ATCATCTAATGGAATGGAATGGAAGAATCCATGG | 5508 |
| TEE-499 | ATCGAATGGAATCATTGAATGGAAAGGAATGGAATC ATCATGGAATGGAAACGAATGGAATCACTGAATGGA CTCGAATGGGATCATCA | 5509 |
| TEE-500 | ATTCAGCCTTTAAAAAAAGAAGACAGTCCTGTCATTT GTGACAATATGAATGAAACAGACATCACATTAAATG AAATGAGCCAGGCGCAG | 5510 |
| TEE-501 | GAATGAAATGAAATCAAATGGAATGTACATGAATGG AATAGAAAAGAATGCATCTTTCTCGAACGGAAGTGC ATTGAATGGAAAGGAATCTACTGGAATGGATTCGAA TGGAATGGAATGGGATGGAATGGTATGG | 5511 |
| TEE-502 | AACATCAAACGGAATCAAACGGAATTATCGAATGGA ATCGAAGAGAATCATCGAACGGACTCGAATGGAATC ATCTAATGGAATGGAATGGAAGAATCCATGGACTCG AATGCAATCATCATCGAATGAAATCGAATGGAATCA TCGAATGGACTCG | 5512 |
| TEE-503 | ATGGAATTCAATGGAATGGACATGAATGGAATGGAC TTCAATGGAATGGTATCAAATGGAATGGAATTCAGT | 5513 |
| TEE-504 | AATGGAAAGGAATCGAATGGAAGGGAATGAAATTG AATCAACAGGAATGGAAGGGAATAGAATAGACGGC AATGGAATGGACTCG | 5514 |
| TEE-505 | AGCAACTTCAGCAAAGTATCAGGATACAAAATCAAT GTACAAAAATCCCAAGCATTCTTATACACCAACAAC AGACAAACAGAGAGCC | 5515 |
| TEE-506 | AGCAACTTCAGCAAAGTCTCAGGATACAAAATCGAT GTGCAAAAATCACAAGCATTCTTATACACCAACAAC AGATAAACAGAGAG CC | 5516 |
| TEE-507 | AACGGAAAAAAACGGAATTATCGAATGGAATCGA AGAGAATCATCGAATGGACCAGAATGGAATCATCTA ATGGAATGGAATGGAATAATCCATGGACTCGAATG | 5517 |

TABLE 32-continued

TEE Sequences

| TEE Identifier | Sequence | SEQ ID NO |
|---|---|---|
| TEE-508 | GGAATCAAACGGAATTATCGAATGGAATCGAAGAGA ATCATAGAACGGACTCAAATGGAATCATCTAATGGA ATGGAATGGGAGAATCCATGGACTCGAATG | 5518 |
| TEE-509 | AATGGAATCAATATCAAACGGAAAAAAACGGAATTA TCGAATGGAATCGAAGAGAATCATCGAATGGACC | 5519 |
| TEE-510 | AACGGAATCAAACGGAATTATCGAATGGAATCGAAA AGAATCATCGAACGGACTCGAATGGAATCATCTAAT GGAATGGAATGGAAGAATCCATGG | 5520 |
| TEE-511 | AAACGGAATTATCGAATGGAATCAAAGAGAATCATC GAATGGCCACGAATGGAATCATATAATGGAATGGAA TGGAATAATCCATGGACC | 5521 |
| TEE-512 | AATGGAATCGAATGGATTGATATCAAATGGAATGGA ATGGAAGGGAATGGAATGGAATGGAATTGAACCAA ATGTAATGGATTTG | 5522 |
| TEE-513 | TAAAAGACGGAACAGATAGAAAGCAGAAAGGAAAG GTGAATTGCATTACCACTATTCATACTGCCACACACA TGACATTAGGCCAAGTC | 5523 |
| TEE-514 | AATGGAATCGAATGGAACAATCAAATGGACTCCAAT GGAGTCATCTAATGGAATCGAGTGGAATCATCGAAT GGACTCG | 5524 |
| TEE-515 | TAACACATAAACAAACACAGAGACAAAATCTCCGAG ATGTTAATCTGCTCCAGCAATACAGAACAATTTCTAT TACCAACAGAATGCTTAATTTTTCTGCCT | 5525 |
| TEE-516 | GGAATCGAATGGAATCAACATCAAACGGAAAAAAA CGGAATTATCGAATGGAATCAAAGAGAATCATCGAA TGGACC | 5526 |
| TEE-517 | AGAATGGAAAGGAATCGAAACGAAAGGAATGGAGA CAGATGGAATGGAATG | 5527 |
| TEE-518 | GAATCATCATAAAATGGAATCGAATGGAATCAACAT CAAATGGAATCAAATGGTCTCGAATGGAATCATCTT CAAATGGAATGGAATGG | 5528 |
| TEE-519 | AACAACAATGACAAACAAACAACAACGACAAAGAC ATTTATTTGGTTCACAAATCTCCAGGGTGTACAAGAA GCATGGTGCCAGCATCTGCTCAGCTTCTGATGAGGG CTCTGGGAAGCTTTTACTC | 5529 |
| TEE-520 | AACGGACTCGAACGGAATATAATGGAATGGAATGGA TTCGAAAGGAATGGAATGGAATGGACAGGAAAAGA ATTGAATGGGATTGGAATGGAATCG | 5530 |
| TEE-521 | AACATCAAACGAAATCAAACGGAATTATCAAATTGA ATCGAAGAGAATCATCGAATTGCCACGAATGCAATC ATCTAATGGTATGGAATGGAATAATCCATGGACCCA GATG | 5531 |
| TEE-522 | AGAAATTAACAGCAAAAGAAGGATGCAGTGCAACTC AGGACAACACATACAATTCAAGCAACAAATGTATAG TGGCTGGGCACCAAGGATACAG | 5532 |
| TEE-523 | GCAATAAAATCGACTCAGATAGAGAAGAATGCAATG GAATGGAATGGAATGGAATGGAATGGGATGGAATG GTATGGAATGG | 5533 |
| TEE-524 | AATGGACTCGAATGAAATCATCATCAAACGGAATCG AATGGAATCATTGAATGGAAAGGATGGGATCATCAT GGAATGGAAACGAATGGAATCACTG | 5534 |
| TEE-525 | CCACATAAAACAAAACTACAAGACAATGATAAAGTT CACAACATTAACACAATCAGTAATGGAAAAGCCTAG TCAATGGCAG | 5535 |
| TEE-526 | TGGAATGGAATGGAATGGAATCAAATCGCATGGTAA TGAATCAAATGGAATCAAATCGAATGGAAATAATGG | 5536 |

TABLE 32-continued

TEE Sequences

| TEE Identifier | Sequence | SEQ ID NO |
|---|---|---|
| | AATCGAAGGGAAACGAATGGAATCGAATTGCACTGA TTCTACTGACTTCGAGGAAAATGAAATGAAATGCGG TGAAGTGGAATGG | |
| TEE-527 | GAATGTTATGAAATCAACTCGAACGGAATGCAATAG AATGGAATGGAATGGAATGGAATGGAATGGAATGG | 5537 |
| TEE-528 | AATGGAATCATTGAATGGAATGGAATGGAATCATCA AGAAAGGAATCGAAGGGAATCATCGAATGGAATC AAACGGAATCATCGAATGGAATGGAATGGAATG | 5538 |
| TEE-529 | GGAATCAACATCAAACGGAAAAAAACGGAATTATC GAATGGAATCGAAGAGAATCATCGAATGGACC | 5539 |
| TEE-530 | GGAATAATCATCATCAAACAGAACCAAATGGAATCA TTGAATGGAATCAAAGGCAATCATGGTCGAATG | 5540 |
| TEE-531 | GCATAGAATCGAATGGAATTATCATTGAATGGAATC GAATGGAATCAACATCAAACGGAAAAAAACGGAAT TATCGAATGGAATCGAAGAGAATCATCGAATGGACCC | 5541 |
| TEE-532 | AATGGAATCGAAGAGAATCATCGAACGGACTCGAAT GGAATCATCTAATGGAATGGAATGGAATAATCCATG GACCCGAATG | 5542 |
| TEE-533 | AAATGAATCGAATGGAATTGAATGGAATCAAATAGA ACAAATGGAATCGAAATGAATCAAATGGAATCGAAT CGAATGGAATTGAATGGCATGGAATTG | 5543 |
| TEE-534 | AGTTAATCCGAATAGAATGGAATGGAATGCAATGGA ACGGAATGGAACGGAATGGAATGGAATGGAATGGA ATGGAATG | 5544 |
| TEE-535 | ATCACAATCACACAACACATTGCACATGCATAACAT GCACTCACAATACACACAACACATACACAACACA CATGCAATACAACACAAAACGCAACACAACATATAC ACAACACACAGCACACACATGCC | 5545 |
| TEE-536 | AAAGACTTAAACGTTAGACCTAAAACCATAAAAACC CTAGAGGAAAACCTAGGCATTACCATTCAGGACTTA GGCATGGGCAAGGAC | 5546 |
| TEE-537 | AAAGTCCAAAGATGAACAAAATATCCAGAAGGAAA ACAAATGCACTTGGGGAGTGGGAAAGAAAACCAAG ACTGAGCAATGCGTCAAGCTCAGACGTGCCTCACTA CG | 5547 |
| TEE-538 | AAACGGAATCAAACGGAATTATCGAATGGAGTCGAA AAGAATCATCGAACGGACTCGAATGGAATCATCTAA TGGAATGGAATGGAAGAATCCATGG | 5548 |
| TEE-539 | AATTGATTCGAAATTAATGGAATTGAATGGAATGCA ATCAAATGGAATGGAATGTAATGCAATGGAATGTAA TAGAATGGAAAGCAATGGAATG | 5549 |
| TEE-540 | TACAGAACACATGACTCAACAACAGCAGAAAGCATA TTCTTTTCAAATGCACATGAAACATTATCATGATGGA CCAAAT | 5550 |
| TEE-541 | GGAACAAAATGAAATCGAACGGTAGGAATCATACA GAACAGAAAGAAATGGAACGGAATGGAATG | 5551 |
| TEE-542 | AACGGAAAAAACGGAATTATCGAATGGAATCGAAG AGAATCATCGAATGGAATCGAATGGAGTCATCG | 5552 |
| TEE-543 | AATCGAACGGAATCAACATCAAACGGAAAAAAACG GAATTATCGAATGGAATCGAAGAGAATCATCGAATG GACC | 5553 |
| TEE-544 | AGAATGGAATGCAATAGAATGGAATGCAATGGAATG GAGTCATCCGTAATGGAATGGAAAGGAATGCAATGG AATGGAATGGAATGG | 5554 |
| TEE-545 | ATGGAATCAACATCAAACGGAATCAAACGGAATTAT CGAATGGAATCGAAGAGAATCATCGAACGGATTCGA | 5555 |

TABLE 32-continued

TEE Sequences

| TEE Identifier | Sequence | SEQ ID NO |
|---|---|---|
| | ATGGAATCATCTAATGGAATGGAATGGAAGAATCCA TGGACTCGAATGCAATCATCAGCGAATGGAATCGAA TGGAATCATCGAATGGACTCG | |
| TEE-546 | GGAATAAAACGGACTCAATAGTAATGGATTGCAATG TAATTGATTCGATTTCGAATGGAATCGCATGGAATGT AATGGAATGGAATGGAATGGAAGGC | 5556 |
| TEE-547 | AATGGAATCAACATCAAACGGAAAAAAACGGAATT ATCGTATGGAATCGAAAAGAATTATCGAATGGACC | 5557 |
| TEE-548 | TCAAACGGAAAAAAACGGAATTATCGAATGGAATCG AAGAGAATCATCGAATGGACC | 5558 |
| TEE-549 | ACATCAAACGGAATCAAACGGAATTATCGAATGGAA TCGAAAAGAATCATCGAACGGACTCGAATGGAATCA TCTAATGGAATGGAATGGAAGAATCCATGGACTCGA ATG | 5559 |
| TEE-550 | TGGAATCGAATGGAATCAACATCAAACGGAAAAAA ACGGAATTATCGAATGGAATCGAAGAGAATCATCGA ATGGACC | 5560 |
| TEE-551 | AATGGAATCGAATGCAATCATCGAACGGAATCGAAT GGCATCACCGAATGGAATGGAATGGAATGGAATGGA ATGG | 5561 |
| TEE-552 | AGAATTGATTGAATCCAAGTGGAATTGAATGGAATG GAATGGATTAGAAAGGAATGGAATGGATTGGAATGG ATTGGAATGGAAAGG | 5562 |
| TEE-553 | AACTGCATCAACTAACAGGCAAAATAACCAGCTAAT ATCATAATGACAGGATTAAATTCACAAATGACAATA TTAACCGTAAATGTAAATGGGCTA | 5563 |
| TEE-554 | GTAAACAAACAATCAAGCAAGTAAGAACAGAAATA ACAGCATTTGGCTTTTGAGTTAATGACAAGAACACTC GGCATGGGAGCCTGGGTGAGCAAATCACAGATCTTC | 5564 |
| TEE-555 | AAAGGAATGGACTGGAACAAAATGAAATCGAACGG TAGGAATCGTACAGAACGGACAGAAATGGAACGGC ATGGAATGCACTCG | 5565 |
| TEE-556 | GAATCAACCCGAGCGGAAAGGAATGGAATGGAATG GAATCAACACGAATGGAATGGAACGGAATGGAATG GGATGGGATGAAATGGAATGG | 5566 |
| TEE-557 | AAGAAATGGAATCGAAGAGAATGGAAACAAACGGA ATGGAATTGAATGGAATGGAATTGAATGGAATGGGA | 5567 |
| TEE-558 | GACATGCAAACACAACACACAGCACACATGGAACAT GCATCAGACATGCAAACACAACACACATACCACACA TGGCATATGCATCAGACGTGCCTCACTAC | 5568 |
| TEE-559 | AAAGGAATGCACTCGAATGGAATGGACTTGAATGGA ATGTCTCCGAATGGAACAGACTCGTATGAAATGGAA TCGAATGGAATGGAATCAAATGGAATTGATTTGAGT GAAATGGAATCAAATGGAATGGCAACG | 5569 |
| TEE-560 | GGAACAAAATGAAATCGAACGGTAGGAATCGTACA GAACGGAAAGAAATGGAACGAATGGAATGCACTC GAATGGAAAGGAGTCCAAT | 5570 |
| TEE-561 | AAATTGATTGAAATCATCATAAAATGGAATCGAAGG GAATCAACATCAAATGGAATCAAATGGAATCATTGA AC GGAATTGAATGGAATC GTCAT | 5571 |
| TEE-562 | AGAATGGAAAGCAATAGAATGGAACGCACTGGATTC GAGTGCAATGGAATCAATTGGAATGGAATCGAATGG AATGGATTGGCA | 5572 |
| TEE-563 | AACACCAAACGGAAAAAAACGGAATTATCGAATGG AATCGAAGAGAATCTTCGAAC GGAC CC GAATGGGAT CATCTAATGGAATGGAATGGAATAATCCATGG | 5573 |

TABLE 32-continued

TEE Sequences

| TEE Identifier | Sequence | SEQ ID NO |
|---|---|---|
| TEE-564 | AATGGAGACTAATGTAATAGAATCAAATGGAATGGC ATCGAATGGAATGGACTGGAATGGAATGTGCATGAA TGGAATGGAATCGAATGGATTG | 5574 |
| TEE-565 | AAATCGAATGGAACGCAATAGAATAGACTCGAATGT AATGGATTGCTATGTAATTGATTCGAATGGAATGGA ATCGACTGGAATGCAATCCAATGGAATGGAATGCAA TGCAATGGAATGGAATCGAACGGAATGCAGTGGAAG GGAATGG | 5575 |
| TEE-566 | AATCAACAAGGAACTGAAACAAGTAAACAAGAAAA CAAATAACACCATAAAACATGGGCAAAGGACATAA ACAGACATTTTTCAAAAAAGACATACAAATGGCCGAG | 5576 |
| TEE-567 | AATGGAATCAACATCAAACGGAAAAAAACGGAATT ATCGAATGGAATCGAAGAGAATCATCGAATGGACCC AGGCTGGTCTTGAACTCC | 5577 |
| TEE-568 | ATTGAATGGGCTAGAATGGAATCATCTTTGAACGGA ATCAAAGGGAATCATCATC GAATGGAATCGAATG GA AATGTCAACG | 5578 |
| TEE-569 | AATGGACTCGAATGGAATCAACATCAAATGGAATCA AGCGGAATTATCGAATGAAATCGAAGAGAATCATCG AATGGACTCGAAAGGAATCATCTAATGGAATGGAAT GGAATAATCCATGGACTCGAATGCAATCATCATCG | 5579 |
| TEE-570 | AAAC GGAAAAAAAC GGAATTATTGAATGGAATCGA AGAGAATCTTCGAACGGACCCGAATGGAATCATCTA ATGGAATGGAATGGAATAATCCATGG | 5580 |
| TEE-571 | ACTCGAGTGGAATTGACTGTAACAAAATGGAAAGTA ACGGATTGGAATCGAATGGAACGGAATGGAATGGA ATGGACAT | 5581 |
| TEE-572 | TACAAACTTTAAAAAATGATCAACAGATACACAGTT AGCAAGAAAGAATTGAGGGCAAAGAATATGCCAGA CAAACTCAAGAGGAAGATGATGGTAGAGATAGGTCA CATTGGAGTGTCA | 5582 |
| TEE-573 | AAATCAACAACAAACGGAAAAAAAAGGAATTATCG AATGGAATCAAAGAGAATCATCGAATGGACC | 5583 |
| TEE-574 | AACGGAATCAAACGGAATTATCGAATGGAATCGAAA AGAATCATCGAACGGACTCGAATGGAATCATCTAAT GTAATGGAATGGAAGAATCCATGGACTCGAATG | 5584 |
| TEE-575 | AACGGAAAAAAACGGAATTATCGAATGGAATCGAA GAGAATCATCGAATGGACCAGAATGGAATCATCTAA TGGAATGGAATGGAATAATCCATGGACTCGAATG | 5585 |
| TEE-576 | CAACATCAAACGGAAAAAAACGGAATTATGGAATG GAATC GAAGAGAATCATCGAATGGAC CC GAATGGAA TCATCTGAAATATAATAGACTCGAAAGGAATG | 5586 |
| TEE-577 | ATGGAATCGAATGGAATGGACTGGAATGGAATGGAT TCGAATGGAATCGAATGGAACAATATGGAATGGTAC CAAATG | 5587 |
| TEE-578 | GAATGGAATCAACATCAAACGGAAAAAAACGGAAT TATCGAATGGAATCGAAGAGAATCATCGAATGGACC | 5588 |
| TEE-579 | AAATGGACTCGAATGGAATCATCATAGAATGGAATC GAATGCAATGGAATGGAATCTTCCGGAATGGAATGG AATGGAATGGAATGGAG | 5589 |
| TEE-580 | GAATCATCATAAAATGGAATCGAATGGAATCAACAT CAAATGGAATCAAATGGAATCATTGAACGGAATTGA ATGGAATCGTCAT | 5590 |
| TEE-581 | ATCGAATGGAATCAACATCAAACGGAAAAAAACGG AATTATCGAATGGAATCGAAGAGAATCATCGAATGG ACC | 5591 |

TABLE 32-continued

TEE Sequences

| TEE Identifier | Sequence | SEQ ID NO |
|---|---|---|
| TEE-582 | AGCAACTTCAGCAAAGTCTCAGGATACAAAATCAAT GTACAAAAATCACAAGCATTCTTATACACCAATAAC AGACAAACAGAGAGCCAAAA | 5592 |
| TEE-583 | AGAAACAGAAAACAGTCAAACCAATGGGCAATCCAT ATCAGATGCAGTATTATGAACAGAAGTGTAAAGAAT GCACCAGGCACAATGGC | 5593 |
| TEE-584 | GATTGGAACGAAATCGAATGGAACGGAATAGAATA GACTC GAATGTAAT GGATTGCTAT GTAATTGATTC GA ATGGAATGGAATCGAATGGAATGCAATCCAATGGAA TGGAATGCAATGCAATGGAATGG | 5594 |
| TEE-585 | ATGGAATGGAATAATCAACGTACTCGAATGCAATCA TCATCGTATAGAATCGAATGGAATCATCGAATGGAC TCGAATGGAATAATCATTGAACGGAGTCGAATGGAA TCATCATCGGATGGAAAC | 5595 |
| TEE-586 | AAAGAAATCGAATGGAATCAGTGTCGAATGGAATGG AATGGAATCGAAGAATTGAATTGAGTAGAATCGAAG GGAATCATTGGATGGGCTCAAAT | 5596 |
| TEE-587 | AGAAAAGATAACTCGATTAACAAATGAACAAACACC TGAATACACAAGTCTCAAAAGAAGACATAAAAATGG CCAAC | 5597 |
| TEE-588 | ATGGAATCAACATCAAACGGAATCACACGGAATTAT CGAATGGAATCGAAAAGAATCATCGAACGGACTC GA ATGGAATCATCTAATGGAATGGAATGGAAG | 5598 |
| TEE-589 | AATGGAATCAACATCAAACGGAATCAAGCGAAATTA TCGAATGGAATCGAAGAGAATCATCGAATGGACTCG AATGGAATCATCTAATGGAATGGAATGGGAT | 5599 |
| TEE-590 | AAACACAGTACAAATACTAATTCAAATCAAACTTAC TCAAAGTCATAATCAAACATGCCAGACGGGCTGAGG GGCAGCATTA | 5600 |
| TEE-591 | GGAATCGAGTGGAATCATCGAAAGAAATCGAATGGA ATCATTGTCGAATGGAATGGAATGGAATCAAAGAAT GGAATCGAAGGGAATCATTGGATGGGCT | 5601 |
| TEE-592 | AAAGAAAGACAGAGAACAAACGTAATTCAAGAT GA CTGTTTACATATCCAAGAACATTAGATGGTCAAAGA CTTTAAGAAGGAATACATTCAAAGGCAAAAAGTCAC TTACTGATTTTGGTGGAGTTTGCCACATGGAC | 5602 |
| TEE-593 | GAAAGGAATCATCATTGAATGCAATCACATGGAATC ATCACAGAATGGAATCGTACGGAATCATCATCGAAT GGAATTGAATGGAATCATCAATTGGACTCGAATGGA ATCATCAAATGGAATCGATTGGAAGTGTCAAATGGA CTCG | 5603 |
| TEE-594 | CAATCAGAGCGGACACAAACAAATTGCATGGGAAG AATCAATATCGTGAAAATGGCC | 5604 |
| TEE-595 | CAGCGCACCACAGCACACACAGTATACACATGACCC ACAATACACACAACACACAACACATTCACACACCAC | 5605 |
| TEE-596 | GCAAACAGAATTCAACACTACATTAGAACGATCATT CATCACGACCTAGTAGGATGTTTTTCCTGGGATGCAA GGATGGTTCAACAT | 5606 |
| TEE-597 | CAATCAAAACAGCAATGAGATACCATTTTACACCAA TCAAAATGGCTACTAAAAAGTCAAAAGCAAATGCC | 5607 |
| TEE-598 | TGGAATAGAATGGAATCAATGTTAAGTGGAATCGAG TGGAATCATCGAAAGAAATCGAATGGAATCATTGTC GAATGGTATGGAATGGAATCA | 5608 |
| TEE-599 | AATGGAATGGAATCATCGCATAGAATGGAATGGAAT TATCATCGAATTGAATCGAATGGTATCAACATCAAA CGGAAAAAAACGGAAATATCGAATGGAATCGAAGA GAATCATCGAACGGACC | 5609 |

TABLE 32-continued

TEE Sequences

| TEE Identifier | Sequence | SEQ ID NO |
|---|---|---|
| TEE-600 | GAAAAACAAAACAAAACAAACAAACAAACAATCAA AAAAGTGGTAGCAGAAACCAGAAAGTCCATGTATAT AGCTAATTGGCCTGGTTGT | 5610 |
| TEE-601 | AGACCTTTCTCAGAAGACACACAAATTGCCAACAGG TATATGAAAAAATGTTCAATATCACTAATCATCAGG GCGATGCC | 5611 |
| TEE-602 | CATGGAATCGAATGGAATTATCATCGAATGGAATCG AATGGTACCAACACCAAACGGAAAAAAACGGAATT ATCGAATGGAATCGAAGAGAATCTTCGAACGGACC | 5612 |
| TEE-603 | AGAGCAGAAACAAATGGAATTGAAATGAAGACAAC AATCAAAAGCATCAATGAAATGAAAAGTTGGGTTTT GGAAGAGAGAAACAAT | 5613 |
| TEE-604 | ACACAAACACACACACACACACACACACACACACAC ACACACACACACACACACACACACACACACATAC | 5614 |
| TEE-605 | AACAAACAAATGAGATGATTTCAGATAGTGATAAAC ACTATAACATAATTAATTCGTGCCAATCAGAGCATA ACAGTGGTGTGGTGGCTGTGGAACAGATAGCAGAC | 5615 |
| TEE-606 | AATGGAATCGAGTGGAATGGAAGGCAATGGAATAG AATGGAATGGAATCGAAAGGAACGGAATGGAATGG AATGGAATG | 5616 |
| TEE-607 | AGAAATGGAATCGGAGAGAATGGAAACAAATGGAA TGGAATTGAATGGAATGGAATTGAATGGAATGGGAA CG | 5617 |
| TEE-608 | AAGAGAACTGCAAAACACTGCTCAAAGAAATCAGA GATGACAAAAACACATGGAAAAACGTTTCATGCTCA TGGATTGGAAGACTTA | 5618 |
| TEE-609 | AATCAACACGAATAGAATGGAACGGAATGGAATGG AATGGAATGGAATGGAATGGAGTGGAATGGAACAG AATGGAGTGGAAT | 5619 |
| TEE-610 | AACATCAAACGAAATCAAACGGAATTATCAAATTGA ATCGAAGAGAATCATCGAATTGCCACGAATGCAACC ATCTAATGGTATGGAATGGAATAATCCATGGACCCA GATG | 5620 |
| TEE-611 | CGGAATTATCATCGAATGTAATCGAATGGAATCAAC ATCAAACGGAAAAAAACGGAATTATCGAATGGAATC GAAGAGAATCATCGAATGGACC | 5621 |
| TEE-612 | TGGACACACACGAACACACACCTACACACACGTGGA CACACACGGACACACATGGACACACACGAACACATGGA CACACACACGGGGACACACACAGACACACACAGAG ACACACACGGACACATGG | 5622 |
| TEE-613 | ATCAAACGGAATCAAACGGAATTATCGAATGGAATC GAAGAGAATCATCGAATGGACTCGAATGGAATCATC TAATGGAATGGAATGGAAGAATCCATGG | 5623 |
| TEE-614 | AAATGGAATGGAATGCACTTGAAAGGAATAGACTGG AACAAAATGAAATCGAACGGTAGGAATCATACAGA ACAGAAAGAAATGGAACGGAATGGAATG | 5624 |
| TEE-615 | AC CACACACAAAATACAC CACACACCACACACACAC CACACACTATACACACACCACACACCACACAC | 5625 |
| TEE-616 | AAAGAAATAGAAGGGAGTTGAACAGAATCGAATGG AATCGAATCAAATGAATCGAATGGCATCAAATGGA ATCGAATGGAATGTGGTGAAGTGGATTGG | 5626 |
| TEE-617 | GGAATCATCATAAAATGGAATCGAATGGAATCATCA TCAAATGGAATCAAATGGAATCATTGAACGGAATTG AATGGAATCGTCAT | 5627 |

TABLE 32-continued

TEE Sequences

| TEE Identifier | Sequence | SEQ ID NO |
|---|---|---|
| TEE-618 | AAAGATCAATGTACAAAAATCAGCAGCATTTCTATA AACCAACAATGTCCAGGCTGAGAGAGAAATCAAGA AAACAATTC | 5628 |
| TEE-619 | TGGAATGGAATGGAATGAAATAAACACGAATAGAAT GGAACGGAATGGAACGGAATGGAATGGAATGGAAT GGAAAG | 5629 |
| TEE-620 | TAATCAGCACAATCAACTGTAGTCACAAAACAAATA GTAACGCAATGATAAAGAAACAGAGAACTAGTTCAA ATAAACATGATAAGATGGGG | 5630 |
| TEE-621 | AAGCGGAATTATCAAATGGAATCGAAGAGAATGGA AACAAATGGAATGGAATTGAATGGAATGGAATTGAA TGGAATG | 5631 |
| TEE-622 | AATGGAATCAACATCAAACGGAAAAAAACGGAATT ATCGAATGGAATCGAAGAGAATCATCGAATGGACC | 5632 |
| TEE-623 | ACTTGAATCGAATGGAAAGGAATTTAATGAACTTAA ATCGAATGGAATATAATGGTATGGAATGGACTCATG GAATGGAATGGAAAGGAATC | 5633 |
| TEE-624 | TGGAATCATCATCGAAAGCAAGCGAATGGAATCATC AAATGGAAACGAATGGAATCATCGAATGGACTCGGA TGGAATTGTTGAATGGACT | 5634 |
| TEE-625 | TGGAATCAACATCAAACGGAAAAAAACGGAATTATC GAATGGAATCGAAGAGAATCATCGAATGGACC | 5635 |
| TEE-626 | TAAGTGAATTGAATAGAATCAATCTGAATGTAATGA AATGGAATGGAACGGAATGGAATGGAATGGAATGG AATGGAATGGAATGG | 5636 |
| TEE-627 | AGGAAAATTTAATCAGCAGGAATAGAAACACACTTG AGAAATCCATGTGGAATGAAAAGAGAATGGCTGAGC AGCAACAGATTGTCAAAAAGGAAATC | 5637 |
| TEE-628 | AACATCAAACGGAAAAAAAACGGAATTATCGAATG GAATCGAAGAGAATCATCGAATGGACC | 5638 |
| TEE-629 | TAATTGAGAATAAGCATTCCAGTGGAAAAAAAACTA AACAATTTGTTGTAAAACATCCTTAAAAGCATCAGA AAGTTAATACAGCAATGAAGAATTACAGGACCAAAT TAAGAATGGTATGGAAGCCTGTTA | 5639 |
| TEE-630 | TATCATCGAATGGAATCGAATGGAATCAACATCAAA CGGAAAAAAACGGAATTATCGAATTGAATCGAAGAG AATCATCGAATGGACC | 5640 |
| TEE-631 | AGCAAAACAAACACAATCTGTCGTTCATGGTACTAC GACATACTGGGAGAGATATTCAAATGATCACACAAA ACAACATG | 5641 |
| TEE-632 | AAGGATTCGAATGGAATGAAAAAGAATTGAATGGA ATAGAACAGAATGGAATCAAATCGAATGAAATGGA GTGGAATAGAAAGGAATGGAATG | 5642 |
| TEE-633 | AACGGAATCAAACGGAATTATCGAATGGAATCGAAG AGAATCATCGAACGGACTCGAATGGAATCATCTAAT GGAATGGAATGGAAGAATCCATGGACTCGAATGCAA TCATCATCGAATGGAATCGAACGGAATCATCGAATG GCC | 5643 |
| TEE-634 | AATCAACTAGATGTCAATGGAATGCAATGGAATAGA ATGGAATGGAATTAACACGAATAGAATGGAATGGAA TGGAATGGAATGG | 5644 |
| TEE-635 | AATGGACTCGAATGGAATAATCATTGAACGGAATCG AATGGAATCATCATCGGATGGAAATGAATGGAATCA TCATCGCATGGAATCG | 5645 |

TABLE 32-continued

TEE Sequences

| TEE Identifier | Sequence | SEQ ID NO |
|---|---|---|
| TEE-636 | GAATGGAATGATACGGAATAGAATGGAATGGAACG AAATGGAATTGAAAGGAAAGGAATGGAATGGAATG GAATGG | 5646 |
| TEE-637 | AATCATCATCGAATGGAATCGAATGGTATCATTGAG TGGAATCGAATGGAATCATCATCAGATGGAAATGAA TGGAATCGTCAT | 5647 |
| TEE-638 | GAATCAAATCAATGGAATCAAATCAAATGGAATGGA ATGGAATTGTATGGAATGGAATGGCATGG | 5648 |
| TEE-639 | TAATGCAGTCCAATAGAATGGAATCGAATGGCATGG AATATAAAGAAATGGAATCGAAGAGAATGGGAACA AATGGAATGGAATTGAGTGGAATGGAATTGAATGGA ATGGGAACGAATGGAGTG | 5649 |
| TEE-640 | AACATCAAACGGAAAAAAACGGAATTATCGAATGG AATCGAAGAGAATCATCGAATGGACC | 5650 |
| TEE-641 | ATCAAAAGGAACGGAATGGAATGGAATGGAATGGA ATGGAATGGAATGGAATGGAATGAAATCAACCCGAA TGGAATGGATTGGCATAGAGTGGAATGG | 5651 |
| TEE-642 | GCCAACAATCATATGAGAAAAAGCTCAACATCACTG ATCATTTCAGGAATGCAAATCAAAACCACAATGAGA TACTATCA | 5652 |
| TEE-643 | AATCAAATGGAATGAAATCGAATGGAATTGAATCGA ATGGAATGCAATAGAATGTCTTCAAATGGAATCGAA TGGAAATTGGTGAAGTGGACGGGAGTG | 5653 |
| TEE-644 | TAATGGAATCAACATCAAACGGAAAAAAACGGAATT ATCGAATGCAATCGAAGAGAATCATCGAATGGACC | 5654 |
| TEE-645 | AGCAACTTCAGCAAAGTCTCAGCATACAAAATCAAT GTGCAAAAATCACACGCATTCCTATACACCAATAAC AGACAAACAGAGAGCC | 5655 |
| TEE-646 | GAATCAAATGGAATGGACTGTAATGGAATGGATTCG AATGGAATCGAATGGAGTGGACTCAAATGGAATG | 5656 |
| TEE-647 | AACAAGTGGACGAAGGATATGAACAGACACTTCTCA AGACATTTATGCAGCCAACAGACACACGAAAAAATG CTCATCATCACTGGCCATCAG | 5657 |
| TEE-648 | AAACGGAAAAAAACGGAATTATCGAATGGAATCGA ATAGAATCATCGAATGGACC | 5658 |
| TEE-649 | TGGAACCGAACAAAGTCATCACCGAATGGAATTGAA ATGAATCATAATCGAATGGAATCAAATGGCATCTTC GAATTGACTCGAATGCAATCATCCACTGGGCTT | 5659 |
| TEE-650 | AACGGAATCACGCGGAATTATCGAATGGAATCGAAG AGAATCATCGAATGGACTCGAATGGAATCATCTAAT GGAATGGAATGG | 5660 |
| TEE-651 | GGAATCAACTCGATTGCAATGGAATGCAATGGAAAG GAATGGAATGCAATTAAAGCGAATAGAATGGAATGG AATGGAATGGAACGGAATGGAATG | 5661 |
| TEE-652 | AAAACAAACAACAACGACAAATCATGAGACCAGAG TTAAGAAACAATGAGACCAGGCTGGGTGTGGTG | 5662 |
| TEE-653 | AATCGAAAGGAATGCAATATTATTGAACAGAATCGA AAAGAATGGAATCAAATGGAATGGAACAGAGTGGA ATGGACTGC | 5663 |
| TEE-654 | AAGGAATCGAATGGAAGTGAATGAAATTGAATCAAC AGGAATGGAAGGGAATAGAATAGACTGTAATGGAA TGGACTCG | 5664 |
| TEE-655 | AACCCGAGTGCAATAGAATGGAATCGAATGGAATGG AATGGAATGGAATGGAATGGAATGGAGTC | 5665 |

TABLE 32-continued

TEE Sequences

| TEE Identifier | Sequence | SEQ ID NO |
|---|---|---|
| TEE-656 | GAATGGAATTGAAAGGAATGGAATGCAATGGAATG GAATGGGATGGAATGGAATGCAATGGAATCAACTCG ATTGCAATG | 5666 |
| TEE-657 | GAAAAAAACGGAATTATCGAATTGAATCAAATAGAA TCATCGAACGGACCAAAATGGAATCATCTAATGGAA TGGAATGGAATAATCCATGGACTCTAATG | 5667 |
| TEE-658 | TGGAATCATCTAATGGAATGGAATGGAATAATCCAT GGACTCGAATGCAATCATCATAAAATGGAATCGAAT GGAATCAACATCAAATGGAATCAAATGGGATCATTG AAC GGAATTGAATG GAATCGT CAT | 5668 |
| TEE-659 | GAAAAAAACGGAATTATCGAATTGAATCGAATAGAA TCATCGAACGGACCAGAATGGAATCATCTAATGGAA TGGAATGGAATAATCCATGGACTCGAATG | 5669 |
| TEE-660 | AACCACTGCTTAAGGAAATAAGAGAGAACACAAAC AAATGGAAAAACGTTCCATGCTCATGGATAGGAGAA TCAATATCGTGAAAATGGCC | 5670 |
| TEE-661 | TATCGAATGGAATGGAAAGGAGTGGAGTAGACTCGA ATAGAATGGACTGGAATGAAATAGATTCGAATGGAA TGGAATGGAATGAAGTGGACTCG | 5671 |
| TEE-662 | GTATCAACATCAAACGGAAAAAAACGGAATTATCGA ATGGAATCATCTAATGGAATGGAATGGAATAATCCA TGGACTCGAATG | 5672 |
| TEE-663 | TAAATGGAGACATCATTGAATACAATTGAATGGAAT CATCACATGGAATCGAATGGAATCATCGTAAATGCA ATCAAGTGGAATCAT | 5673 |
| TEE-664 | GAATGGAATTGAAAGGTATCAACACCAAACGGAAA AAAAAACGGAATTATCGAATGGAATCGAAGAGAATC ATCGAACGGACC | 5674 |
| TEE-665 | AGCAATTTCAGCAAAGTCTCAGGATACAAAATCAAT GTACAAATTCACAAGCATTCTTATGGACCAACAACAG | 5675 |
| TEE-666 | GGAATCGAATGGCATCAACATCAAACGGAAAAAAA CGGAATTATCGAATGGAATCGAATGGAATCATC | 5676 |
| TEE-667 | AAACAAAACACAGAAATGCAAAGACAAAACATAAA ACGCAGCCATAAAGGACATATTTTAGATAACTGGGG AAATTTGTATGGGCTGTGT | 5677 |
| TEE-668 | AATGGAATCAACATCAAACGGAATCAAACGGAATTA TCGAATGGAATCGAAGAGAATCATCGAACGGACTCG AATGGAATCATCTAATGGAATGGAATGGAAG | 5678 |
| TEE-669 | AATCGAATGGAATCAGCATCAAACGGAAAAAAACG GAATTATCGAATGGAATCGAAGAGAATCATCGAATG GACC | 5679 |
| TEE-670 | AAACGGAATTATAGAATGGACTGGAAGAGAATCATC GAACGGACTAGAATGGAATCATCTAATCGAATGGAA TGGAACAATCCATGGTCTAGCA | 5680 |
| TEE-671 | TGAACAGAGAATTGGACAAAACGCACAAAGTAAAG AAAAAGAATGAAGCAACAAAAGCAGAGATTTATTG AAAACAAAAGTACACACCACACAGGGTGGGAGTGG | 5681 |
| TEE-672 | ATCATAACGACAAGAACAAATTCACACACAACAATA TTAACTTCAAATCCAAATGGGTTAAATGCTCCAATTA AAGGATGCAGACGGGCAAATTGGATA | 5682 |
| TEE-673 | ATCATAACGACAAGAACAAATTCACACACAACAATA TTCACTTCAAATCCAAATGGGTTAAATGCTCCAATTA AAGGATGCAGACGGGCAAATTGGATA | 5683 |
| TEE-674 | GAATGGAATCGAATGGATTGATATCAACTGGAATGG AATGGAAGGGAATGGAATGGAATGGAATTGAACCA AATGTAATGACTTGAATGGAATG | 5684 |

TABLE 32-continued

TEE Sequences

| TEE Identifier | Sequence | SEQ ID NO |
|---|---|---|
| TEE-675 | GAATCAACATCAAACGGAAAAAAACGGAATTATCGA ATGGAATCGAAGAGAATCATCGAATGGACC | 5685 |
| TEE-676 | GGAATCAACATCAAACGGAAAAAAACGGAATTATCG AATGGAATCGAAGAGAATCATCGAATGGACC | 5686 |
| TEE-677 | ATGGAATCAACATCAAACGGAATCAAACGGAATTAT CGAATGGAATCAAAGAGAATCATCGAACGGACTC GA ATGGAATCATCTAATGGAATGGAATGGAAGAATCCA TGGACTCGAATGCAATCATCATCGAAT | 5687 |
| TEE-678 | GGAATGGAATGGAATGGAGCCGAATGGAATGGAAT GTACTCAAATGGAATGC | 5688 |
| TEE-679 | AAAACACCTAGGAATACAGATAACAAGGGACATTAA CTACCTCTTAAAGAGAACTACAAACCACTGCTCAAG GAAATGAGAGAGGACACAAACACATGGAAAAACAT TCCATCCTCATGGATAGGAAGAATCAATATTGTGAA AATGGCC | 5689 |
| TEE-680 | AACACGACTTTGAGAAGAGTAAGTGATTGTTAATTA AAGCAAGAGAATTATTGATGTATCACAGTCATGAGA AATATTGGAAGGAATATGGTCCATAC | 5690 |
| TEE-681 | ACACATATCAAACAAACAAAAGCAATTGACTATCTA GAAATGTCTGGGAAATGGCAAGATATTACA | 5691 |
| TEE-682 | GGAATCATCATATAATGGAATCGAATGGAATCAACA TCAAATGGAATCAAATGGAATCATTGAACGGAATTG AATGGAATCGTCAT | 5692 |
| TEE-683 | AATGGAATCAACATCAAACGGAATCAAATGGAATTA TCGAATGGAATCGAAGAGAATCATCGAATTGTCACG AATGGAATCATCTAATGGAATGGAATGGAATAATCC ATGGCCCCTATGCAATGGACTCGAATGAAATCATCA TCAAACAGAATCGAATGGAATCATCTAATGGAATGG AATGGCATAATCCATGGACTCGAATG | 5693 |
| TEE-684 | TAAAATGAAACAAATATACAACACGAAGGTTATCAC CAGAAATATGCCAAAACTTAAATATGAGAATAAGAC AGTCTCAGGGGCCACAGAG | 5694 |
| TEE-685 | AAAATACAGCGTTATGAAAAGAATGAACACACACAC ACACACACACACAGAAAATGT | 5695 |
| TEE-686 | CAAACAAATAGGTACCAAACAAATAACAACATAAAC CTGACAACACACTTATTTACAAGAGACATCCCTTATA TGAAAGGGTACAGAAAAGTCGATGGTAAGATGATGG GGAAAGGTATACCAACCACTAGCAGAAGG | 5696 |
| TEE-687 | TGGAATCGAATGGAATCAATATCAAACGGAAAAAAA CGGAATTATCGAATGGAATCGAAAAGAATCATCGAA TGGGCCCGAATGGAATCATCT | 5697 |
| TEE-688 | ACAAATGGAATCAACAACGAATGGAATCGAATGGA AACGCCATCGAAAGGAAACGAATGGAATTATCATGA AATTGAAATGGATG | 5698 |
| TEE-689 | AATCAATAAATGTAAACCAGCATATAAACAGAACCA ACGACAAAAACCACATGATTATCTCAATAGATGCAG AAAAGGCC | 5699 |
| TEE-690 | AAAATAAACGCAAATTAAAATCACAAGATACCAACA CATTCCCACGGCTAAGTACGAAGAACAAGGGCGAAT GGTCAGAATTAAGCTCAAACCT | 5700 |
| TEE-691 | CAACATCAAACGGAATCAAACGGAATTATCGAATGG AATCGAAGAGAATCATCGAATGGACTCGAATGGAAT CATCTAATGGAATGGAATGGAAG | 5701 |
| TEE-692 | ACATCAAACGGAAAAAAACGGAATTATCGAATGGA ATCGAAGAGAATCATCGAATGGACC | 5702 |
| TEE-693 | AATGGACTCGAATAGAATTGACTGGAATGGAATGGA CTCGAATGGAATGGAATGGAATGGAAGGGACTCG | 5703 |

TABLE 32-continued

TEE Sequences

| TEE Identifier | Sequence | SEQ ID NO |
|---|---|---|
| TEE-694 | AAGAAAGACAGAGAACAAACGTAATTCAAGATGAC TGATTACATATCCAAGAACATTAGATGGTCAAAGAC TTTAAGAAGGAATACATTCAAAGGCAAAACGTCACT TACTGATTTTGGTGGAGTTTGCCACATGGAC | 5704 |
| TEE-695 | GAATGGAATCGAATGGAATGAACATCAAACGGAAA AAAACGGAATTATCGAATGGAATCAAAGAGAATCAT CGAATGGACCCG | 5705 |
| TEE-696 | ATGGACTCGAATGTAATAATCATTGAACGGAATCGA ATGGAATCATCATCGGATGGAAACGAATGGAATCAT CATCGAATGGAATCGAATGGGATC | 5706 |
| TEE-697 | GAAATGGAATGGAAAGGAATAAAATCAAGTGAAAT TGGATGGAATGGATTGGAATGGATTGGAATG | 5707 |
| TEE-698 | AAACGGAAAAAAAACGGAATTATCGAATGGAATCG AAGAGAATCATCGAACGAACCAGAATGGAATCATCT AATGGAATGGAATGGAATAATCCATGG | 5708 |
| TEE-699 | ATTAACCCGAATAGAATGGAATGGAATGGAATGGAA CGGAACGGAATGGAATGGAATGGAATGGAATGGAA TGGATCG | 5709 |
| TEE-700 | AACATCAAACGGAAAAAAACGGAATTATCGTATGGA ATCGAAGAGAATCATCGAATGGACC | 5710 |
| TEE-701 | GAATAGAATTGAATCATCATTGAATGGAATCGAGTA GAATCATTGAAATCGAATGGAATCATCATCGAATGG AATTGGGTGGAATC | 5711 |
| TEE-702 | CACCGAATAGAATCGAATGGAACAATCATCGAATGG ACTCAAATGGAATTATCCTCAAATGGAATCGAATGG AATTATCG | 5712 |
| TEE-703 | AATGCAATCGAATAGAATCATCGAATAGACTCGAAT GGAATCATCGAATGGAATGGAATGGAACAGTC | 5713 |
| TEE-704 | AAATCATCATCGAATGGAATCGAATGGTATCATTGA ATGGAATCGAATGGAATCATCATCAGATGGAAATGA ATGGAATCGTCAT | 5714 |
| TEE-705 | GAATGGAATCGAAAGGAATAGAATGGAATGGATCGT TATGGAAAGACATCGAATGGAATGGAATTGACTCGA ATGGAATGGACTGGAATGGAACG | 5715 |

Example 35

In Vitro Expression of Modified Nucleic Acids with miR-122

MicroRNA controls gene expression through the translational suppression and/or degradation of target messenger RNA. The expression of G-CSF mRNA and Factor IX mRNA with human or mouse alpha-globin 3' untranslated regions (UTRs) were down regulated in human primary hepatocytes using miR-122 sequences in the 3'UTR.

Primary human hepatocytes were seeded at a density of 350000 per well in 500 ul cell culture medium (InVitro GRO medium from Celsis, Chicago, Ill.).

G-CSF mRNA having a human alpha-globin 3'UTR (G-CSF Hs3'UTR; mRNA sequence shown in SEQ ID NO: 5716; polyA tail of approximately 140 nucleotides not shown in sequence; 5' cap, Cap1) or a mouse alpha-globin 3'UTR (G-CSF Mm3'UTR; mRNA sequence shown in SEQ ID NO: 5717; polyA tail of approximately 140 nucleotides not shown in sequence; 5' cap, Cap1) were fully modified with 5-methylcytidine and 1-methylpseudouridine. G-CSF mRNA containing a human 3'UTR having a miR-122 sequence in the 3'UTR (G-CSF Hs3'UTR miR-122; mRNA sequence shown in SEQ ID NO: 5018; polyA tail of approximately 140 nucleotides not shown in sequence; 5' cap, Cap1), or a miR-122 seed sequence in the 3'UTR (G-CSF Hs3'UTR miR-122 seed; mRNA sequence shown in SEQ ID NO: 5020; polyA tail of approximately 140 nucleotides not shown in sequence; 5' cap, Cap1) or a miR-122 sequence without the seed sequence in the 3'UTR (G-CSF Hs3'UTR miR-122 seedless; mRNA sequence shown in SEQ ID NO: 5022; polyA tail of approximately 140 nucleotides not shown in sequence; 5' cap, Cap1) were fully modified with 5-methylcytidine and 1-methylpseudouridine. G-CSF mRNA containing a mouse 3'UTR having a miR-122 sequence in the 3'UTR (G-CSF Mm3'UTR miR-122; mRNA sequence shown in SEQ ID NO: 5024; polyA tail of approximately 140 nucleotides not shown in sequence; 5' cap, Cap1), or a miR-122 seed sequence in the 3'UTR (G-CSF Mm3'UTR miR-122 seed; mRNA sequence shown in SEQ ID NO: 5026; polyA tail of approximately 140 nucleotides not shown in sequence; 5' cap, Cap1) or a miR-122 sequence without the seed sequence in the 3'UTR (G-CSF Mm3'UTR miR-122 seedless; mRNA sequence shown in SEQ ID NO: 5028; polyA tail of approximately 140 nucleotides not shown in sequence; 5' cap, Cap1) were fully modified with 5-methylcytidine and 1-methylpseudouridine.

Factor IX mRNA having a human alpha-globin 3'UTR (Factor IX Hs3'UTR; mRNA sequence shown in SEQ ID NO: 5718; polyA tail of approximately 140 nucleotides not shown in sequence; 5' cap, Cap1) or a mouse alpha-globin 3'UTR (Factor IX Mm3'UTR; mRNA sequence shown in SEQ ID NO: 5719; polyA tail of approximately 140 nucleotides not shown in sequence; 5' cap, Cap1) were fully modified with 5-methylcytidine and 1-methylpseudouridine. Factor IX mRNA containing a human 3'UTR having a miR-122 sequence in the 3'UTR (Factor IX Hs3'UTR miR-122; mRNA sequence shown in SEQ ID NO: 5030; polyA tail of approximately 140 nucleotides not shown in sequence; 5' cap, Cap1), or a miR-122 seed sequence in the 3'UTR (Factor IX Hs3'UTR miR-122 seed; mRNA sequence shown in SEQ ID NO: 5032; polyA tail of approximately 140 nucleotides not shown in sequence; 5' cap, Cap1) or a miR-122 sequence without the seed sequence in the 3'UTR (Factor IX Hs3'UTR miR-122 seedless; mRNA sequence shown in SEQ ID NO: 5034; polyA tail of approximately 140 nucleotides not shown in sequence; 5' cap, Cap1) were fully modified with 5-methylcytidine and 1-methylpseudouridine. Factor IX mRNA containing a mouse 3'UTR having a miR-122 sequence in the 3'UTR (Factor IX Mm3'UTR miR-122; mRNA sequence shown in SEQ ID NO: 5036; polyA tail of approximately 140 nucleotides not shown in sequence; 5' cap, Cap1), or a miR-122 seed sequence in the 3'UTR (Factor IX Mm3'UTR miR-122 seed; mRNA sequence shown in SEQ ID NO: 5038; polyA tail of approximately 140 nucleotides not shown in sequence; 5' cap, Cap1) or a miR-122 sequence without the seed sequence in the 3'UTR (Factor IX Mm3'UTR miR-122 seedless; mRNA sequence shown in SEQ ID NO: 5040; polyA tail of approximately 140 nucleotides not shown in sequence; 5' cap, Cap1) were fully modified with 5-methylcytidine and 1-methylpseudouridine.

Each G-CSF or Factor IX mRNA sequence was tested at a concentration of 500 ng per well in 24 well plates. 24, 48 and 72 hours after transfection, the expression of protein was measured by ELISA. The protein levels for G-CSF are shown in Table 33 and the protein levels for Factor IX are shown in Table 34.

TABLE 33

G-CSF Protein Expression

| Description | Protein Expression (ng/ml) | | |
| --- | --- | --- | --- |
| | 24 Hours | 48 Hours | 72 Hours |
| G-CSF Hs3'UTR | 43.9 | 18.8 | 5.7 |
| G-CSF Hs3'UTR miR-122 | 6.9 | 0.7 | 0.12 |
| G-CSF Hs3'UTR miR-122 seed | 48.5 | 25.6 | 8.2 |
| G-CSF Hs3'UTR miR-122 seedless | 31.7 | 11.7 | 3.4 |
| G-CSF Mm3'UTR | 84.9 | 100.4 | 21.3 |
| G-CSF Mm3'UTR miR-122 | 24.0 | 3.03 | 0.8 |
| G-CSF Mm3'UTR miR-122 seed | 115.8 | 96.4 | 19.2 |
| G-CSF Mm3'UTR miR-122 seedless | 113.1 | 92.9 | 18.9 |

TABLE 34

Factor IX Protein Expression

| Description | Protein Expression (ng/ml) | | |
| --- | --- | --- | --- |
| | 24 Hours | 48 Hours | 72 Hours |
| Factor IX Hs3'UTR | 63.2 | 124.8 | 44.3 |
| Factor IX Hs3'UTR miR-122 | 15.9 | 4.4 | 0.4 |
| Factor IX Hs3'UTR miR-122 seed | 60.2 | 63.0 | 20.1 |
| Factor IX Hs3'UTR miR-122 seedless | 53.7 | 75.0 | 24.5 |
| Factor IX Mm3'UTR | 90.8 | 159.6 | 70.5 |
| Factor IX Mm3'UTR miR-122 | 11.8 | 5.0 | 1.0 |
| Factor IX Mm3'UTR miR-122 seed | 77.2 | 115.0 | 41.7 |
| Factor IX Mm3'UTR miR-122 seedless | 69.3 | 123.8 | 49 |

Example 36

In Vitro Expression of Modified Nucleic Acid with mir-142 or miR-146 binding sites HeLa and RAW264 cells were seeded at a density of 17000 and 80000 per well respectively, in 100 ul cell culture medium (DMEM+10% FBS).

G-CSF mRNA (G-CSF; mRNA sequence shown in SEQ ID NO: 4258; polyA tail of approximately 140 nucleotides not shown in sequence; 5' cap, Cap1) was fully modified with 5-methylcytidine and 1-methylpseudouridine.

G-CSF mRNA having a miR-142-3p sequence in the 3'UTR (G-CSF miR-142-3p; mRNA sequence shown in SEQ ID NO: 4992; polyA tail of approximately 140 nucleotides not shown in sequence; 5' cap, Cap1), or a miR-142-3p seed sequence in the 3'UTR (G-CSF miR-142-3p seed; mRNA sequence shown in SEQ ID NO: 4994; polyA tail of approximately 140 nucleotides not shown in sequence; 5' cap, Cap1) or a miR-142-3p sequence without the seed sequence in the 3'UTR (G-CSF miR-142-3p seedless; mRNA sequence shown in SEQ ID NO: 4996; polyA tail of approximately 140 nucleotides not shown in sequence; 5' cap, Cap1) were fully modified with 5-methylcytidine and 1-methylpseudouridine.

G-CSF mRNA having a miR-142-5p sequence in the 3'UTR (G-CSF miR-142-5p; mRNA sequence shown in SEQ ID NO: 4986; polyA tail of approximately 140 nucleotides not shown in sequence; 5' cap, Cap1), or a miR-142-5p seed sequence in the 3'UTR (G-CSF miR-142-5p seed; mRNA sequence shown in SEQ ID NO: 4988; polyA tail of approximately 140 nucleotides not shown in sequence; 5' cap, Cap1) or a miR-142-5p sequence without the seed sequence in the 3'UTR (G-CSF miR-142-5p seedless; mRNA sequence shown in SEQ ID NO: 4990; polyA tail of approximately 140 nucleotides not shown in sequence; 5' cap, Cap1) were fully modified with 5-methylcytidine and 1-methylpseudouridine.

G-CSF mRNA having a miR-146a sequence in the 3'UTR (G-CSF miR-146a; mRNA sequence shown in SEQ ID NO: 4998; polyA tail of approximately 140 nucleotides not shown in sequence; 5' cap, Cap1), or a miR-146a seed sequence in the 3'UTR (G-CSF miR-146a seed; mRNA sequence shown in SEQ ID NO: 5000; polyA tail of approximately 140 nucleotides not shown in sequence; 5' cap, Cap1) or a miR-146a sequence without the seed sequence in the 3'UTR (G-CSF miR-146a seedless; mRNA sequence shown in SEQ ID NO: 5002; polyA tail of approximately 140 nucleotides not shown in sequence; 5' cap, Cap1) were fully modified with 5-methylcytidine and 1-methylpseudouridine.

Each G-CSF mRNA sequence was tested at a concentration of 500 ng per well in 24 well plates for each cell type. 24 hours after transfection, the expression of protein was measured by ELISA and the protein levels are shown in Table 35. The G-CSF sequences with a miR-142-3p sequence in the 3'UTR down regulated G-CSF expression in RAW264 cells whereas the G-CSF sequences with a miR-142-5p or miR-146a sequence in the 3'UTR did not down regulate G-CSF expression.

TABLE 35

G-CSF Expression

| Description | HeLa Cells Protein Expression (ng/ml) | RAW264 Cells Protein Expression (ng/ml) |
|---|---|---|
| G-CSF | 243.5 | 173.7 |
| G-CSF miR-142-3p | 309.1 | 67.6 |
| G-CSF miR-142-3p seed | 259.8 | 178.1 |
| G-CSF miR-142-3p seedless | 321.7 | 220.2 |
| G-CSF miR-142-5p | 291.8 | 223.3 |
| G-CSF miR-142-5p seed | 261.3 | 233.1 |
| G-CSF miR-142-5p seedless | 330.2 | 255.1 |
| G-CSF miR-146a | 272.6 | 125.2 |
| G-CSF miR-146a seed | 219.4 | 138.3 |
| G-CSF miR-146a seedless | 217.7 | 132.8 |

Example 37

Effect of Kozak Sequence on Expression of Modified Nucleic Acids

HeLa cells were seeded at a density of 17000 per well in 100 ul cell culture medium (DMEM+10% FBS). G-CSF mRNA having an IRES sequence and Kozak sequence (G-CSF IRES Kozak; mRNA sequence shown in SEQ ID NO: 5004; polyA tail of approximately 140 nucleotides not shown in sequence; 5' cap, Cap1), G-CSF mRNA having an IRES sequence but not a Kozak sequence (G-CSF IRES; mRNA sequence shown in SEQ ID NO: 5006; polyA tail of approximately 140 nucleotides not shown in sequence; 5' cap, Cap1), G-CSF mRNA without an IRES or Kozak sequence (GCSF no Kozak; mRNA sequence shown in SEQ ID NO: 5008; polyA tail of approximately 140 nucleotides not shown in sequence; 5' cap, Cap1) or a G-CSF sequence having a Kozak sequence (G-CSF Kozak; mRNA sequence shown in SEQ ID NO: 5720; polyA tail of approximately 140 nucleotides not shown in sequence; 5' cap, Cap1) were fully modified with fully modified with 5-methylcytidine and 1-methylpseudouridine and tested at a concentration of 75 ng per well in 24 well plates. 24 hours after transfection, the expression of G-CSF was measured by ELISA, and the results are shown in Table 36.

TABLE 36

G-CSF expression

| Description | Protein Expression (ng/ml) |
|---|---|
| G-CSF IRES Kozak | 2.01 |
| G-CSF IRES | 1.64 |
| G-CSF no Kozak | 795.53 |
| G-CSF Kozak | 606.28 |

Example 38

MALAT1 Constructs

Modified mRNA encoding G-CSF or mCherry with a human or mouse MALAT1 sequence and their corresponding cDNA sequences are shown below in Table 37. In Table 37, the start codon of each sequence is underlined and the MALAT1 sequences are bolded.

TABLE 37

MALAT1 Constructs

| | Sequence | SEQ ID NO: |
|---|---|---|
| G-CSF with Mouse MALAT1 sequence | Optimized G-CSF cDNA sequence containing a T7 polymerase site, kozak sequence, and a Mouse MALAT1 sequence (bold): TAATACGACTCACTATA GGGAAATAAGAGAGAAAAGAAGAGTAAGAAGAAATA TAAGAGCCACC ATGGCCGGTCCCGCGACCCAAAGCCCCATGAAACTTA TGGCCCTGCAGTTGCTGCTTTGGCACTCGGCCCTCTGG ACAGTCCAAGAAGCGACTCCTCTCGGACCTGCCTCAT CGTTGCCGCAGTCATTCCTTTTGAAGTGTCTGGAGCAG GTGCGAAAGATTCAGGGCGATGGAGCCGCACTCCAAG AGAAGCTCTGCGCGACATACAAACTTTGCCATCCCGA GGAGCTCGTACTGCTCGGGCACAGCTTGGGGATTCCC TGGGCTCCTCTCTCGTCCTGTCCGTCGCAGGCTTTGCA GTTGGCAGGGTGCCTTTCCCAGCTCCACTCCGGTTTGT TCTTGTATCAGGGACTGCTGCAAGCCCTTGAGGGAAT CTCGCCAGAATTGGGCCCGACGCTGGACACGTTGCAG CTCGACGTGGCGGATTTCGCAACAACCATCTGGCAGC AGATGGAGGAACTGGGGATGGCACCCGCGCTGCAGCC CACGCAGGGGGCAATGCCGGCCTTTGCGTCCGCGTTT CAGCGCAGGGCGGGTGGAGTCCTCGTAGCGAGCCACC TTCAATCATTTTTGGAAGTCTCGTACCGGGTGCTGAGA CATCTTGCGCAGCCG TGATAATAG GATTCGTCAGTAGGGTTGTAAAGGTTTTTCTTTTCC TGAGAAAACAACCTTTTGTTTTCTCAGGTTTTGCTT TTTGGCCTTTCCCTAGCTTTAAAAAAAAAAAAGCAA AAGTGGTCTTTGAATAAAGTCTGAGTGGGCGGCTCTA GA | 5721 |
| | mRNA sequence (transcribed): GGGAAAUAAGAGAGAAAAGAAGAGUAAGAAGAAAU AUAAGAGCCACC AUGGCCGGUCCCGCGACCCAAAGCCCCAUGAAACUU AUGGCCCUGCAGUUGCUGCUUUGGCACUCGGCCCUC UGGACAGUCCAAGAAGCGACUCCUCUCGGACCUGCC UCAUCGUUGCCGCAGUCAUUCCUUUUGAAGUGUCUG GAGCAGGUGCGAAAGAUUCAGGGCGAUGGAGCCGCA CUCCAAGAGAAGCUCUGCGCGACAUACAAACUUUGC CAUCCCGAGGAGCUCGUACUGCUCGGGCACAGCUUG GGGAUUCCCUGGGCUCCUCUCUCGUCCUGUCCGUCG CAGGCUUUGCAGUUGGCAGGGUGCCUUUCCCAGCUC CACUCCGGUUUGUUCUUGUAUCAGGGACUGCUGCAA GCCCUUGAGGGAAUCUCGCCAGAAUUGGGCCCGACG CUGGACACGUUGCAGCUCGACGUGGCGGAUUUCGCA ACAACCAUCUGGCAGCAGAUGGAGGAACUGGGGAUG GCACCCGCGCUGCAGCCCACGCAGGGGGCAAUGCCG GCCUUUGCGUCCGCGUUUCAGCGCAGGGCGGGUGGA GUCCUCGUAGCGAGCCACCUUCAAUCAUUUUUGGAA GUCUCGUACCGGGUGCUGAGACAUCUUGCGCAGCCG UGAUAAUAG GAUUCGUCAGUAGGGUUGUAAAGGUUUUUCUUUU CCUGAGAAAACAACCUUUUGUUUUCUCAGGUUUUG CUUUUUGGCCUUUCCCUAGCUUUAAAAAAAAAAAA GCAAAAGUGGUCUUUGAAUAAAGUCUGAGUGGGCG GC | 5722 |

TABLE 37-continued

MALAT1 Constructs

| Sequence | | SEQ ID NO: |
|---|---|---|
| mCherry with Mouse MALAT1 sequence | Optimized mCherry cDNA sequence containing a T7 polymerase site, kozak sequence, and a Mouse MALAT1 sequence (bold): TAATACGACTCACTATA GGGAAATAAGAGAGAAAAGAAGAGTAAGAAGAAATA TAAGAGCCACC ATGGTATCCAAGGGGAGGAGGACAACATGGCGATC ATCAAGGAGTTCATGCGATTCAAGGTGCACATGGAAG GTTCGGTCAACGGACACGAATTTGAAATCGAAGGAGA GGGTGAAGGAAGGCCCTATGAAGGGACACAGACCGC GAAACTCAAGGTCACGAAAGGGGGACCACTTCCTTTC GCCTGGGACATTCTTTCGCCCCAGTTTATGTACGGGTC CAAAGCATATGTGAAGCATCCCGCCGATATTCCTGAC TATCTGAAACTCAGCTTTCCCGAGGGATTCAAGTGGG AGCGGGTCATGAACTTTGAGGACGGGGGTGTAGTCAC CGTAACCCAAGACTCAAGCCTCCAAGACGGCGAGTTC ATCTCAAGGTCAAACTGCGGGGGACTAACTTTCCGT CGGATGGGCCGGTGATGCAGAAGAAAACGATGGGAT GGGAAGCGTCATCGGAGAGGATGTACCCAGAAGATG GTGCATTGAAGGGGGAGATCAAGCAGAGACTGAAGTT GAAAGATGGGGGACATTATGATGCCGAGGTGAAAAC GACATACAAAGCGAAAAAGCCGGTGCAGCTTCCCGGA GCGTATAATGTGAATATCAAGTTGGATATTACTTCACA CAATGAGGACTACACAATTGTCGAACAGTACGAACGC GCTGAGGGTAGACACTCGACGGGAGGCATGGACGAG TTGTACAAA TGATAATAG GATTCGTCAGTAGGGTTGTAAAGGTTTTTCTTTTCC TGAGAAAACAACCTTTTGTTTTCTCAGGTTTTGCTT TTTGGCCTTTCCCTAGCTTTAAAAAAAAAAAAGCAA AAGTGGTCTTTGAATAAAGTCTGAGTGGGCGGCTCTA GA | 5723 |
| | mRNA sequence (transcribed): GGGAAAUAAGAGAGAAAAGAAGAGUAAGAAGAAAU AUAAGAGCCACC AUGGUAUCCAAGGGGAGGAGGACAACAUGGCGAUC AUCAAGGAGUUCAUGCGAUUCAAGGUGCACAUGGAA GGUUCGGUCAACGGACACGAAUUUGAAAUCGAAGGA GAGGGUGAAGGAAGGCCCUAUGAAGGGACACAGACC GCGAAACUCAAGGUCACGAAAGGGGGACCACUUCCU UUCGCCUGGGACAUUCUUUCGCCCCAGUUUAUGUAC GGGUCCAAAGCAUAUGUGAAGCAUCCCGCCGAUAUU CCUGACUAUCUGAAACUCAGCUUUCCCGAGGGAUUC AAGUGGGAGCGGGUCAUGAACUUUGAGGACGGGGG UGUAGUCACCGUAACCCAAGACUCAAGCCUCCAAGA CGGCGAGUUCAUCUACAAGGUCAAACUGCGGGGGAC UAACUUUCCGUCGGAUGGGCCGGUGAUGCAGAAGAA AACGAUGGGAUGGGAAGCGUCAUCGGAGAGGAUGU ACCCAGAAGAUGGUGCAUUGAAGGGGGAGAUCAAG CAGAGACUGAAGUUGAAAGAUGGGGGACAUUAUGAU GCCGAGGUGAAAACGACAUACAAAGCGAAAAAGCCG GUGCAGCUUCCCGGAGCGUAUAAUGUGAAUAUCAAG UUGGAUAUUACUUCACACAAUGAGGACUACACAAUU GUCGAACAGUACGAACGCGCUGAGGGUAGACACUCG ACGGGAGGCAUGGACGAGUUGUACAAA UGAUAAUAG GAUUCGUCAGUAGGGUUGUAAAGGUUUUUCUUUU CCUGAGAAAACAACCUUUUGUUUUCUCAGGUUUUG CUUUUUGGCCUUUCCCUAGCUUUAAAAAAAAAAAA GCAAAAGUGGUCUUUGAAUAAAGUCUGAGUGGGCG GC | 5724 |
| G-CSF with Human MALAT1 sequence | Optimized G-CSF cDNA sequence containing a T7 polymerase site, kozak sequence, and a Human MALAT1 sequence (bold): TAATACGACTCACTATA GGGAAATAAGAGAGAAAAGAAGAGTAAGAAGAAATA TAAGAGCCACC ATGGCCGGTCCCGCGACCCAAAGCCCCATGAAACTTA TGGCCCTGCAGTTGCTGCTTTGGCACTCGGCCCTCTGG ACAGTCCAAGAAGCGACTCCTCTCGGACCTGCCTCAT CGTTGCCGCAGTCATTCCTTTTGAAGTGTCTGGAGCAG GTGCGAAAGATTCAGGGCGATGGAGCCGCACTCCAAG AGAAGCTCTGCGCGACATACAAACTTTGCCATCCCGA GGAGCTCGTACTGCTCGGGCACAGCTTGGGGATTCCC TGGGCTCCTCTCTCGTCCTGTCCGTCGCAGGCTTTGCA GTTGGCAGGGTGCCTTTCCCAGCTCCACTCCGGTTTGT TCTTGTATCAGGGACTGCTGCAAGCCCTTGAGGGAAT CTCGCCAGAATTGGGCCCGACGCTGGACACGTTGCAG CTCGACGTGGCGGATTTCGCAACAACCATCTGGCAGC AGATGGAGGAACTGGGGATGGCACCCGCGCTGCAGCC CACGCAGGGGGCAATGCCGGCCTTTGCCTCCGCGTTT CAGCGCAGGGCGGTGGAGTCCTCGTAGCGAGCCACC TTCAATCATTTTTGGAAGTCTCGTACCGGGTGCTGAGA CATCTTGCGCAGCCG TGATAATAG TGCTCTTCAGTAGGGTCATGAAGGTTTTTCTTTTCC TGAGAAAACAACACGTATTGTTTTCTCAGGTTTTGC TTTTTGGCCTTTTTCTAGCTTAAAAAAAAAAAAAGC AAAAGTGGTCTTTGAATAAAGTCTGAGTGGGCGGCTC TAGA | 5725 |
| | mRNA sequence (transcribed): GGGAAAUAAGAGAGAAAAGAAGAGUAAGAAGAAAU AUAAGAGCCACC AUGGCCGGUCCCGCGACCCAAAGCCCCAUGAAACUU AUGGCCCUGCAGUUGCUGCUUUGGCACUCGGCCCUC UGGACAGUCCAAGAAGCGACUCCUCUCGGACCUGCC UCAUCGUUGCCGCAGUCAUUCCUUUUGAAGUGUCUG GAGCAGGUGCGAAAGAUUCAGGGCGAUGGAGCCGCA CUCCAAGAGAAGCUCUGCGCGACAUACAAACUUUGC CAUCCCGAGGAGCUCGUACUGCUCGGGCACAGCUUG GGGAUUCCCUGGGCUCCUCUCUCGUCCUGUCCGUCG CAGGCUUUGCAGUUGGCAGGGUGCCUUUCCCAGCUC CACUCCGGUUUGUUCUUGUAUCAGGGACUGCUGCAA GCCCUUGAGGGAAUCUCGCCAGAAUUGGGCCCGACG CUGGACACGUUGCAGCUCGACGUGGCGGAUUUCGCA ACAACCAUCUGGCAGCAGAUGGAGGAACUGGGGAUG GCACCCGCGCUGCAGCCCACGCAGGGGGCAAUGCCG GCCUUUGCCUCCGCGUUUCAGCGCAGGGCGGUGGA GUCCUCGUAGCGAGCCACCUUCAAUCAUUUUUGGAA GUCUCGUACCGGGUGCUGAGACAUCUUGCGCAGCCG UGAUAAUAG UGCUCUUCAGUAGGGUCAUGAAGGUUUUUCUUUUC CUGAGAAAACAACACGUAUUGUUUUCUCAGGUUUU GCUUUUUGGCCUUUUUCUAGCUUAAAAAAAAAAAA AGCAAAAGUGGUCUUUGAAUAAAGUCUGAGUGGGC GGC | 5726 |
| mCherry with Human MALAT1 sequence | Optimized mCherry cDNA sequence containing a T7 polymerase site, kozak sequence, and a Human MALAT1 sequence (bold): TAATACGACTCACTATA GGGAAATAAGAGAGAAAAGAAGAGTAAGAAGAAATA TAAGAGCCACC ATGGTATCCAAGGGGAGGAGGACAACATGGCGATC ATCAAGGAGTTCATGCGATTCAAGGTGCACATGGAAG GTTCGGTCAACGGACACGAATTTGAAATCGAAGGAGA GGGTGAAGGAAGGCCCTATGAAGGGACACAGACCGC GAAACTCAAGGTCACGAAAGGGGGACCACTTCCTTTC GCCTGGGACATTCTTTCGCCCCAGTTTATGTACGGGTC CAAAGCATATGTGAAGCATCCCGCCGATATTCCTGAC TATCTGAAACTCAGCTTTCCCGAGGGATTCAAGTGGG AGCGGGTCATGAACTTTGAGGACGGGGTGTAGTCAC CGTAACCCAAGACTCAAGCCTCCAAGACGGCGAGTTC ATCTACAAGGTCAAACTGCGGGGGACTAACTTTCCGT CGGATGGGCCGGTGATGCAGAAGAAAACGATGGGAT GGGAAGCGTCATCGGAGAGGATGTACCCAGAAGATG GTGCATTGAAGGGGGAGATCAAGCAGAGACTGAAGTT GAAAGATGGGGGACATTATGATGCCGAGGTGAAAAC GACATACAAAGCGAAAAAGCCGGTGCAGCTTCCCGGA GCGTATAATGTGAATATCAAGTTGGATATTACTTCACA CAATGAGGACTACACAATTGTCGAACAGTACGAACGC | 5727 |

TABLE 37-continued

MALAT1 Constructs

| Sequence | SEQ ID NO: |
|---|---|
| GCTGAGGGTAGACACTCGACGGGAGGCATGGACGAG<br>TTGTACAA<br>TGATAATAG<br>TGCTCTTCAGTAGGGTCATGAAGGTTTTTCTTTTCC<br>TGAGAAAACAACACGTATTGTTTTCTCAGGTTTTGC<br>TTTTTGGCCTTTTTCTAGCTTAAAAAAAAAAAAAGC<br>AAAAGTGGTCTTTGAATAAAGTCTGAGTGGGCGGCTC<br>TAGA | |
| mRNA sequence (transcribed):<br>GGGAAAUAAGAGAGAAAAGAAGAGUAAGAAGAAAU<br>AUAAGAGCCACC<br><u>AUG</u>GUAUCCAAGGGGGAGGAGGACAACAUGGCGAUC<br>AUCAAGGAGUUCAUGCGAUUCAAGGUGCACAUGGAA<br>GGUUCGGUCAACGGACACGAAUUUGAAAUCGAAGGA<br>GAGGGUGAAGGAAGGCCCUAUGAAGGGACACAGACC<br>GCGAAACUCAAGGUCACGAAAGGGGGACCACUUCCU<br>UUCGCCUGGGACAUUCUUUCGCCCCAGUUUAUGUAC<br>GGGUCCAAAGCAUAUGUGAAGCAUCCCGCCGAUAUU<br>CCUGACUAUCUGAAACUCAGCUUUCCCGAGGGAUUC<br>AAGUGGGAGCGGGUCAUGAACUUUGAGGACGGGGG<br>UGUAGUCACCGUAACCCAAGACUCAAGCCUCCAAGA<br>CGGCGAGUUCAUCUACAAGGUCAAACUGCGGGGGAC<br>UAACUUUCCGUCGGAUGGGCCGGUGAUGCAGAAGAA<br>AACGAUGGGAUGGGAAGCGUCAUCGGAGAGGAUGU<br>ACCCAGAAGAUGGUGCAUUGAAGGGGGAGAUCAAGC<br>AGAGACUGAAGUUGAAAGAUGGGGGACAUUAUGAU<br>GCCGAGGUGAAAACGACAUACAAAGCGAAAAAGCCG<br>GUGCAGCUUCCCGGAGCGUAUAAUGUGAAUAUCAAG<br>UUGGAUAUUACUUCACACAAUGAGGACUACACAAUU<br>GUCGAACAGUACGAACGCGCUGAGGGUAGACACUCG<br>ACGGGAGGCAUGGACGAGUUGUACAAA<br>UGAUAAUAG<br>UGCUCUUCAGUAGGGUCAUGAAGGUUUUUCUUUUC<br>CUGAGAAAACAACACGUAUUGUUUUCUCAGGUUUU<br>GCUUUUUGGCCUUUUUCUAGCUUAAAAAAAAAAAA<br>AGCAAAAGUGGUCUUUGAAUAAAGUCUGAGUGGGC<br>GGC | 5728 |

These modified mRNA sequences can include at least one chemical modification described herein. The G-CSF or mCherry modified mRNA sequence can be formulated, using methods described herein and/or known in the art, prior to transfection and/or administration.

The modified mRNA sequence encoding G-CSF or mCherry can be transfected in vitro to various cell types such as HEK293, HeLa, PBMC and BJ fibroblast and those described in Table 25 using methods disclosed herein and/or are known in the art. The cells are then analyzed using methods disclosed herein and/or are known in the art to determine the concentration of G-CSF or mCherry and/or the cell viability.

Example 39

Utilization of Heterologous 5'UTRs

A 5' UTR may be provided as a flanking region to the nucleic acids, modified nucleic acids or mmRNA of the invention. 5'UTR may be homologous or heterologous to the coding region found in the nucleic acids, modified nucleic acids or mmRNA of the invention. Multiple 5' UTRs may be included in the flanking region and may be the same or of different sequences. Any portion of the flanking regions, including none, may be codon optimized and any may independently contain one or more different structural or chemical modifications, before and/or after codon optimization.

Shown in Lengthy Table 21 in U.S. Provisional Application No. 61/775,509, filed Mar. 9, 2013, entitled Heterologous Untranslated Regions for mRNA and in Lengthy Table 21 in U.S. Provisional Application No. 61/829,372, filed May 31, 2013, entitled Heterologous Untranslated Regions for mRNA is a listing of the start and stop site of the polynucleotides, primary constructs or mmRNAs of the invention. Each 5'UTR (5'UTR-005 to 5'UTR 68511) is identified by its start and stop site relative to its native or wild type (homologous) transcript (ENST; the identifier used in the ENSEMBL database).

To alter one or more properties of the nucleic acids, modified nucleic acids or mmRNA of the invention, 5'UTRs which are heterologous to the coding region of the nucleic acids, modified nucleic acids or mmRNA of the invention are engineered into compounds of the invention. The nucleic acids, modified nucleic acids or mmRNA are then administered to cells, tissue or organisms and outcomes such as protein level, localization and/or half life are measured to evaluate the beneficial effects the heterologous 5'UTR may have on the nucleic acids, modified nucleic acids or mmRNA of the invention. Variants of the 5' UTRs may be utilized wherein one or more nucleotides are added or removed to the termini, including A, T, C or G. 5'UTRs may also be codon-optimized or modified in any manner described herein.

Example 40

Further Utilization of 5' Untranslated Regions

A 5' UTR may be provided as a flanking region to the nucleic acids, modified nucleic acids or mmRNA of the invention. 5'UTR may be homologous or heterologous to the coding region found in the nucleic acids, modified nucleic acids or mmRNA of the invention. Multiple 5' UTRs may be included in the flanking region and may be the same or of different sequences. Any portion of the flanking regions, including none, may be codon optimized and any may independently contain one or more different structural or chemical modifications, before and/or after codon optimization.

Shown in Table 38 is a listing of 5'-untranslated regions which may be used with the nucleic acids, modified nucleic acids or mmRNA of the present invention.

To alter one or more properties of the nucleic acids, modified nucleic acids or mmRNA of the invention, 5'UTRs which are heterologous to the coding region of the nucleic acids, modified nucleic acids or mmRNA of the invention are engineered into compounds of the invention. The nucleic acids, modified nucleic acids or mmRNA are then administered to cells, tissue or organisms and outcomes such as protein level, localization and/or half life are measured to evaluate the beneficial effects the heterologous 5'UTR may have on the nucleic acids, modified nucleic acids or mmRNA of the invention. Variants of the 5' UTRs may be utilized wherein one or more nucleotides are added or removed to the termini, including A, T, C or G. 5'UTRs may also be codon-optimized or modified in any manner described herein.

TABLE 38

5'-Untranslated Regions

| 5' UTR Identifier | Name/ Description | Sequence | SEQ ID NO. |
|---|---|---|---|
| 5UTR-68512 | Upstream UTR | GGGAGATCAGAGAGAAAAGAAGAGTAAGAAGAAATA TAAGAGCCACC | 5729 |
| 5UTR-68513 | Upstream UTR | GGAATAAAAGTCTCAACACAACATATACAAAACAAAC GAATCTCAAGCAATCAAGCATTCTACTTCTATTGCAGC AATTTAAATCATTTCTTTTAAAGCAAAAGCAATTTTCT GAAAATTTTCACCATTTACGAACGATAGCAAC | 5730 |
| 5UTR-68514 | Upstream UTR | GGGAGACAAGCUUGGCAUUCCGGUACUGUUGGUAAA GCCACC | 5731 |
| 5UTR-68515 | Upstream UTR | GGGAATTAACAGAGAAAAGAAGAGTAAGAAGAAATA TAAGAGCCACC | 5732 |
| 5UTR-68516 | Upstream UTR | GGGAAATTAGACAGAAAAGAAGAGTAAGAAGAAATA TAAGAGCCACC | 5733 |
| 5UTR-68517 | Upstream UTR | GGGAAATAAGAGAGTAAAGAACAGTAAGAAGAAATA TAAGAGCCACC | 5734 |
| 5UTR-68518 | Upstream UTR | GGGAAAAAAGAGAGAAAAGAAGACTAAGAAGAAATA TAAGAGCCACC | 5735 |
| 5UTR-68519 | Upstream UTR | GGGAAATAAGAGAGAAAAGAAGAGTAAGAAGATATA TAAGAGCCACC | 5736 |
| 5UTR-68520 | Upstream UTR | GGGAAATAAGAGACAAAACAAGAGTAAGAAGAAATA TAAGAGCCACC | 5737 |
| 5UTR-68521 | Upstream UTR | GGGAAATTAGAGAGTAAAGAACAGTAAGTAGAATTAA AAGAGCCACC | 5738 |
| 5UTR-68522 | Upstream UTR | GGGAAATAAGAGAGAATAGAAGAGTAAGAAGAAATA TAAGAGCCACC | 5739 |
| 5UTR-68523 | Upstream UTR | GGGAAATAAGAGAGAAAAGAAGAGTAAGAAGAAAAT TAAGAGCCACC | 5740 |
| 5UTR-68524 | Upstream UTR | GGGAAATAAGAGAAAAGAAGAGTAAGAAGAAATT TAAGAGCCACC | 5741 |

Example 41

Protein Production Using Heterologous 5'UTRs

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in 5% $CO_2$ atmosphere overnight. The next day, 37.5 ng, 75 ng or 150 of G-CSF modified RNA comprising a nucleic acid sequence for 5UTR-001 (mRNA sequence shown in SEQ ID NO: 5; polyA tail of approximately 140 nucleotides not shown in sequence; 5' cap, Cap1; fully modified with 5-methylcytidine and 1-methylpseudouridine), G-CSF modified RNA comprising a nucleic acid sequence for 5UTR-68515 (mRNA sequence shown in SEQ ID NO: 5732; polyA tail of approximately 140 nucleotides not shown in sequence; 5' cap, Cap1; fully modified with 5-methylcytidine and 1-methylpseudouridine), G-CSF modified RNA comprising a nucleic acid sequence for 5UTR-68516 (mRNA sequence shown in SEQ ID NO: 5733; polyA tail of approximately 140 nucleotides not shown in sequence; 5' cap, Cap1; fully modified with 5-methylcytidine and 1-methylpseudouridine), G-CSF modified RNA comprising a nucleic acid sequence for 5UTR-68521 (mRNA sequence shown in SEQ ID NO: 5738; polyA tail of approximately 140 nucleotides not shown in sequence; 5' cap, Cap1; fully modified with 5-methylcytidine and 1-methylpseudouridine) or G-CSF modified RNA comprising a nucleic acid sequence for 5UTR-68522 (mRNA sequence shown in SEQ ID NO: 5739; polyA tail of approximately 140 nucleotides not shown in sequence; 5' cap, Cap1; fully modified with 5-methylcytidine and 1-methylpseudouridine) were diluted in 10 ul final volume of OPTI-MEM (LifeTechnologies, Grand Island, N.Y.). Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature.

After an incubation of 24 hours cells expressing G-CSF were lysed with 100 ul of Passive Lysis Buffer (Promega, Madison, Wis.) according to manufacturer instructions. G-CSF protein production was determined by ELISA.

These results, shown in Table 39, demonstrate that G-CSF mRNA comprising the 5UTR-68515 or 5UTR-68521 produced the most protein whereas G-CSF mRNA comprising 5UTR-68522 produced the least amount of protein.

TABLE 39

G-CSF Protein Production from Heterologous 5'UTRs

| 5'UTR | G-CSF Protein (ng/ml) | | |
|---|---|---|---|
| | 37.5 ng | 75 ng | 150 ng |
| 5UTR-001 | 131.3 | 191.1 | 696.1 |
| 5UTR-68515 | 245.6 | 394.3 | 850.3 |
| 5UTR-68516 | 188.6 | 397.4 | 719.6 |
| 5UTR-68521 | 191.4 | 449.1 | 892.1 |
| 5UTR-68522 | 135.9 | 331.3 | 595.6 |

Example 42

Effect of the Kozak Sequence in Modified Nucleic Acids

HeLa cells were seeded at a density of 15,000 per well in 100 ul cell culture medium DMEM+FBS 10%. G-CSF mRNA having a Kozak sequence (G-CSF Kozak; mRNA sequence shown in SEQ ID NO: 5004; polyA tail of approximately 140 nucleotides not shown in sequence; 5' cap, Cap1; fully modified with 5-methylcytidine and 1-methylpseudouridine) or G-CSF mRNA not having a Kozak sequence (G-CSF no Kozak; mRNA sequence shown in SEQ ID NO: 5008; polyA tail of approximately 140 nucleotides not shown in sequence; 5' cap, Cap1; fully modified with 5-methylcytidine and 1-methylpseudouridine) and transfected in triplicate at a concentration of 75 ng per well in 96 well plates. 24 hours, 48 hours and 72 hours after transfection, the supernatant was collected and expression of G-CSF was measured by ELISA, and the results are shown in Table 40.

TABLE 40

G-CSF Expression

| Time point | G-CSF Kozak Protein Expression (ng/ml) | G-CSF No Kozak Protein Expression (ng/ml) |
|---|---|---|
| 24 hours | 223.93 | 408.23 |
| 48 hours | 604.76 | 1217.29 |
| 72 hours | 365.48 | 703.93 |

Example 43

Effect of the Altering the 5'UTR in Modified Nucleic Acids mRNA encoding a polypeptide of interest and having a polyA sequence and a cap, is fully modified with at least one chemistry described herein and/or in co-pending International Publication No WO2013052523, the contents of which are herein incorporated by reference in its entirety and the mRNA comprises a 5'UTR from Table 41. HeLa cells are seeded in cell culture medium and are transfected with the mRNA at a pre-determined concentration (ng per well) in well plates. At pre-determined intervals (e.g., 2 hours, 4 hours, 6 hours, 8 hours, 10 hours, 12 hours, 14 hours, 16 hours, 18 hours, 20 hours, 22 hours, 24 hours, 36 hours, 48 hours, 60 hours and/or 72 hours) after transfection, the supernatant is collected and expression of protein is measured by ELISA.

TABLE 41

5' UTR

| 5' UTR Identifier | Name/Description | Sequence | SEQ ID NO. |
|---|---|---|---|
| 5UTR-001 | Synthetic UTR | GGGAAATAAGAGAGAAAAGAAGAGTAAGAAG AAATATAAGAGCCACC | 5 |
| 5UTR-68525 | Synthetic UTR | GGGAAATAAGAGAGAAAAGAAGAGTAAGAAG AAATATAAGAGCCTCC | 5742 |
| 5UTR-68526 | Synthetic UTR | GGGAAATAAGAGAGAAAAGAAGAGTAAGAAG AAATATATGA | 5743 |
| 5UTR-68527 | Synthetic UTR | GGGAAATAAGAGAGAAAAGAAGAGTAAGAAG AAATATA | 5744 |

Example 44

Effect of the PolyA Tail Length in Modified Nucleic Acids

A. Bioanalyzer

Modified G-CSF mRNA (mRNA sequence shown in SEQ ID NO: 5745; 5' cap, Cap 1 fully modified with 5-methylcytidine and 1-methylpseudouridine (5mc/1mpU) or fully modified with 1-methylpseudouridine (1mpU)), modified Factor IX (FIX) mRNA (mRNA sequence shown in SEQ ID NO: 5746; 5' cap, Cap 1 fully modified with 5-methylcytidine and 1-methylpseudouridine (5mc/1mpU) or fully modified with 1-methylpseudouridine (1mpU)), modified erythropoietin (EPO) mRNA (mRNA sequence shown in SEQ ID NO: 5747; 5' cap, Cap 1 fully modified with 5-methylcytidine and 1-methylpseudouridine (5mc/1mpU) or fully modified with 1-methylpseudouridine (1mpU)) or modified mCherry mRNA (mRNA sequence shown in SEQ ID NO: 5748; 5' cap, Cap 1 fully modified with 5-methylcytidine and 1-methylpseudouridine (5mc/1mpU) or fully modified with 1-methylpseudouridine (1mpU)) having a polyA tail of 20, 40, 80, 100, 120, 140 or 160 nucleotides in length or no polyA tail were analyzed by bioanalyzer (Agilent 2100 bioanalyzer). All samples, maintained integrity of the mRNA as determined by bioanalyzer.

B. BJ Fibroblasts

Human primary foreskin fibroblasts (BJ fibroblasts) are obtained from American Type Culture Collection (ATCC) (catalog #CRL-2522) and grown in Eagle's Minimum Essential Medium (ATCC, cat#11095-114) supplemented with 10% fetal bovine serum at 37° C., under 5% $CO_2$. BJ fibroblasts are seeded on a 24-well plate at a density of 100,000 cells per well in 0.5 ml of culture medium. 250 ng of modified G-CSF mRNA (mRNA sequence shown in SEQ ID NO: 5745; 5' cap, Cap 1 fully modified with 5-methylcytidine and 1-methylpseudouridine (5mc/1mpU) or fully modified with 1-methylpseudouridine (1mpU)), modified Factor IX (FIX) mRNA (mRNA sequence shown in SEQ ID NO: 5746; 5' cap, Cap 1 fully modified with 5-methylcytidine and 1-methylpseudouridine (5mc/1mpU) or fully modified with 1-methylpseudouridine (1mpU)), modified erythropoietin (EPO) mRNA (mRNA sequence shown in SEQ ID NO: 5747; 5' cap, Cap 1 fully modified with 5-methylcytidine and 1-methylpseudouridine (5mc/1mpU) or fully modified with 1-methylpseudouridine (1mpU)) or modified mCherry mRNA (mRNA sequence shown in SEQ ID NO: 5748; 5' cap, Cap 1 fully modified with 5-methylcytidine and 1-methylpseudouridine (5mc/1mpU) or fully modified with 1-methylpseudouridine (1mpU)) having a polyA tail of 20, 40, 80, 100, 120, 140 or 160 nucleotides in length or no polyA tail were transfected using Lipofectamine 2000, following manufacturer's protocol. FIX, G-CSF and EPO were transfected in triplicate.

The supernatant was collected at 24 hours, 48 hours and 72 hours for FIX, G-CSF and EPO and at 24 hours for mCherry. The protein expression was analyzed by ELISA for FIX, G-CSF and EPO and fluorescence-activated cell sorting (FACS) for mCherry. The results for G-CSF are shown in Table 42, the results for EPO are shown in Table 43, the results for FIX are shown in Table 44 and the results for mCherry are shown in Table 45.

TABLE 42

G-CSF Protein Expression

| Description | PolyA Tail Length | Time Point | Protein (ng/ml) |
|---|---|---|---|
| G-CSF 5mC/1mpU | 0 | 24 | 1.13 |
| | | 48 | 0.39 |
| | | 72 | 0.2 |
| G-CSF 1mpU | 0 | 24 | 2 |
| | | 48 | 0.3 |
| | | 72 | 0.16 |
| G-CSF 5mC/1mpU | 20 | 24 | 41.85 |
| | | 48 | 32.75 |
| | | 72 | 13.38 |
| G-CSF 1mpU | 20 | 24 | 204.43 |
| | | 48 | 138.71 |
| | | 72 | 96.36 |
| G-CSF 5mC/1mpU | 40 | 24 | 102.75 |
| | | 48 | 101.96 |
| | | 72 | 48.97 |
| G-CSF 1mpU | 40 | 24 | 451.71 |
| | | 48 | 373.75 |
| | | 72 | 217.62 |
| G-CSF 5mC/1mpU | 80 | 24 | 135.85 |
| | | 48 | 167.21 |
| | | 72 | 96.66 |
| G-CSF 1mpU | 80 | 24 | 534.89 |
| | | 48 | 352.39 |
| | | 72 | 203.89 |
| G-CSF 5mC/1mpU | 100 | 24 | 168.31 |
| | | 48 | 195.16 |
| | | 72 | 127.8 |

TABLE 42-continued

G-CSF Protein Expression

| Description | PolyA Tail Length | Time Point | Protein (ng/ml) |
|---|---|---|---|
| G-CSF 1mpU | 100 | 24 | 561 |
| | | 48 | 406.8 |
| | | 72 | 265.64 |
| G-CSF 5mC/1mpU | 120 | 24 | 152.54 |
| | | 48 | 187.06 |
| | | 72 | 100.41 |
| G-CSF 1mpU | 120 | 24 | 656.23 |
| | | 48 | 511.01 |
| | | 72 | 239.95 |
| G-CSF 5mC/1mpU | 140 | 24 | 146.24 |
| | | 48 | 202.05 |
| | | 72 | 121.89 |
| G-CSF 1mpU | 140 | 24 | 724.58 |
| | | 48 | 627.6 |
| | | 72 | 341.61 |
| G-CSF 5mC/1mpU | 160 | 24 | 59.83 |
| | | 48 | 101.30 |
| | | 72 | 64.69 |
| G-CSF 1mpU | 160 | 24 | 814.54 |
| | | 48 | 579.65 |
| | | 72 | 274.7 |

TABLE 43

EPO Protein Expression

| Description | PolyA Tail Length | Time Point | Protein (ng/ml) |
|---|---|---|---|
| EPO 5mC/1mpU | 0 | 24 | 3.12 |
| | | 48 | 0.13 |
| | | 72 | 0 |
| EPO 1mpU | 0 | 24 | 0.77 |
| | | 48 | 0.07 |
| | | 72 | 0.007 |
| EPO 5mC/1mpU | 20 | 24 | 48.93 |
| | | 48 | 21.72 |
| | | 72 | 5.88 |
| EPO 1mpU | 20 | 24 | 199.24 |
| | | 48 | 42.9 |
| | | 72 | 20.29 |
| EPO 5mC/1mpU | 40 | 24 | 400.66 |
| | | 48 | 165.38 |
| | | 72 | 63.36 |
| EPO 1mpU | 40 | 24 | 210 |
| | | 48 | 182.56 |
| | | 72 | 54.31 |
| EPO 5mC/1mpU | 80 | 24 | 368.09 |
| | | 48 | 303.05 |
| | | 72 | 117.98 |
| EPO 1mpU | 80 | 24 | 422.95 |
| | | 48 | 229.53 |
| | | 72 | 131.05 |
| EPO 5mC/1mpU | 100 | 24 | 619.59 |
| | | 48 | 366.19 |
| | | 72 | 199.63 |
| EPO 1mpU | 100 | 24 | 374.88 |
| | | 48 | 240.21 |
| | | 72 | 128.08 |
| EPO 5mC/1mpU | 120 | 24 | 430.64 |
| | | 48 | 354.6 |
| | | 72 | 165.72 |
| EPO 1mpU | 120 | 24 | 358.02 |
| | | 48 | 193.77 |
| | | 72 | 104.89 |
| EPO 5mC/1mpU | 140 | 24 | 531 |
| | | 48 | 426.96 |
| | | 72 | 164.3 |
| EPO 1mpU | 140 | 24 | 355.96 |
| | | 48 | 202.27 |
| | | 72 | 99.88 |
| EPO 5mC/1mpU | 160 | 24 | 608.66 |
| | | 48 | 324.31 |
| | | 72 | 181.94 |

TABLE 43-continued

EPO Protein Expression

| Description | PolyA Tail Length | Time Point | Protein (ng/ml) |
|---|---|---|---|
| EPO 1mpU | 160 | 24 | 351.01 |
|  |  | 48 | 197.76 |
|  |  | 72 | 109.64 |

TABLE 44

FIX Protein Expression

| Description | PolyA Tail Length | Time Point | Protein (ng/ml) |
|---|---|---|---|
| FIX 5mC/1mpU | 0 | 24 | 0.51 |
|  |  | 48 | 1.14 |
|  |  | 72 | 0.47 |
| FIX 1mpU | 0 | 24 | 0.61 |
|  |  | 48 | 0.39 |
|  |  | 72 | 0.36 |
| FIX 5mC/1mpU | 20 | 24 | 0.92 |
|  |  | 48 | 0.46 |
|  |  | 72 | 0.49 |
| FIX 1mpU | 20 | 24 | 5.97 |
|  |  | 48 | 14.99 |
|  |  | 72 | 7.47 |
| FIX 5mC/1mpU | 40 | 24 | 2.27 |
|  |  | 48 | 1.62 |
|  |  | 72 | 0.5 |
| FIX 1mpU | 40 | 24 | 15.32 |
|  |  | 48 | 41.92 |
|  |  | 72 | 21.05 |
| FIX 5mC/1mpU | 80 | 24 | 7.12 |
|  |  | 48 | 10.14 |
|  |  | 72 | 3.66 |
| FIX 1mpU | 80 | 24 | 35.32 |
|  |  | 48 | 74.18 |
|  |  | 72 | 38.47 |
| FIX 5mC/1mpU | 100 | 24 | 8.47 |
|  |  | 48 | 13.33 |
|  |  | 72 | 6.73 |
| FIX 1mpU | 100 | 24 | 40.5 |
|  |  | 48 | 90.56 |
|  |  | 72 | 54.85 |
| FIX 5mC/1mpU | 120 | 24 | 10.06 |
|  |  | 48 | 15.89 |
|  |  | 72 | 6.2 |
| FIX 1mpU | 120 | 24 | 47.5 |
|  |  | 48 | 106.55 |
|  |  | 72 | 59.35 |
| FIX 5mC/1mpU | 140 | 24 | 11.16 |
|  |  | 48 | 20.13 |
|  |  | 72 | 8.85 |
| FIX 1mpU | 140 | 24 | 46.44 |
|  |  | 48 | 109.03 |
|  |  | 72 | 60.17 |
| FIX 5mC/1mpU | 160 | 24 | 13.06 |
|  |  | 48 | 22.31 |
|  |  | 72 | 10.19 |
| FIX 1mpU | 160 | 24 | 45.35 |
|  |  | 48 | 99.47 |
|  |  | 72 | 60.48 |

TABLE 45 mCherry Expression

| Description | PolyA Tail Length | Time Point | Expression index |
|---|---|---|---|
| mCherry 5mC/1mpU | 0 | 24 | 445946.66 |
| mCherry 1mpU | 0 | 24 | 509423.33 |
| mCherry 5mC/1mpU | 20 | 24 | 510846.66 |
| mCherry 1mpU | 20 | 24 | 1688910 |
| mCherry 5mC/1mpU | 40 | 24 | 1443583.33 |

TABLE 45-continued mCherry Expression

| Description | PolyA Tail Length | Time Point | Expression index |
|---|---|---|---|
| mCherry 1mpU | 40 | 24 | 3398540 |
| mCherry 5mC/1mpU | 80 | 24 | 1949826.66 |
| mCherry 1mpU | 80 | 24 | 5783383.33 |
| mCherry 5mC/1mpU | 100 | 24 | 4963426.66 |
| mCherry 1mpU | 100 | 24 | 4639580 |
| mCherry 5mC/1mpU | 120 | 24 | 5372706.66 |
| mCherry 1mpU | 120 | 24 | 9184466.66 |
| mCherry 5mC/1mpU | 140 | 24 | 5127563.33 |
| mCherry 1mpU | 140 | 24 | 5273213.33 |
| mCherry 5mC/1mpU | 160 | 24 | 5627163.33 |
| mCherry 1mpU | 160 | 24 | 4876160 |

Example 45

Modified Nucleic Acids with a mir-122 Sequence

A. HeLa Cells

HeLa cells were seeded at a density of 15,000 per well in 100 ul cell culture medium (DMEM+10% FBS). G-CSF mRNA having a miR-122 sequence in the 3'UTR (G-CSF miR122; mRNA sequence shown in SEQ ID NO: 5024; polyA tail of approximately 140 nucleotides not shown in sequence; 5' cap, Cap 1; fully modified with 5-methylcytidine and 1-methylpseudouridine) or G-CSF mRNA having a miR-122 sequence without the seed sequence in the 3'UTR (G-CSF seedless; mRNA sequence shown in SEQ ID NO: 5028; polyA tail of approximately 140 nucleotides not shown in sequence; 5' cap, Cap1; fully modified with 5-methylcytidine and 1-methylpseudouridine) were transfected with 0.3 ul per well of Lipofectamine 2000 at a concentration of 75 ng of mRNA per well in 96 well plates. The supernatant was collected between 16-18 hours after transfection and expression of G-CSF was measured by ELISA, and the results are shown in Table 46.

TABLE 46

G-CSF Expression in HeLa

| Description | Protein Expression (ng/ml) |
|---|---|
| G-CSF miR122 | 292.1 |
| G-CSF seedless | 335.7 |

B. Primary Human and Rat Hepatocytes

Primary human or rat hepatocytes cells were seeded at a density of 350,000 cells per well in 500 ul cell culture medium (InvitroGRO CP and InVitroGRO HI Medium+ 2.2% Torpedo Antibiotic Mix). G-CSF mRNA having a miR-122 sequence in the 3'UTR (G-CSF miR122; mRNA sequence shown in SEQ ID NO: 5024; polyA tail of approximately 140 nucleotides not shown in sequence; 5' cap, Cap1; fully modified with 5-methylcytidine and 1-methylpseudouridine) or G-CSF mRNA having a miR-122 sequence without the seed sequence in the 3'UTR (G-CSF seedless; mRNA sequence shown in SEQ ID NO: 5028; polyA tail of approximately 140 nucleotides not shown in sequence; 5' cap, Cap1; fully modified with 5-methylcytidine and 1-methylpseudouridine) were transfected with 1 ul per well of Lipofectamine 2000 at a concentration of 500 ng of mRNA per well in 24 well plates for the primary human hepatocytes and the primary rat hepatocytes. The supernatant was collected between 16-18 hours after transfection and expression of G-CSF was measured by ELISA, and the results are shown in Table 47. The mir-122 binding site sequence in the mRNA dampened the G-CSF protein expression in the primary hepatocytes.

TABLE 47

G-CSF Expression in Hepatocytes

| Description | Primary Human Hepatocytes Protein Expression (ng/ml) | Primary Rat Hepatocytes Protein Expression (ng/ml) |
|---|---|---|
| G-CSF miR122 | 116 | 26 |
| G-CSF seedless | 463 | 85 |

Example 46

Time Course of Modified Nucleic Acids with a mir-122 Sequence

A. HeLa Cells

HeLa cells were seeded at a density of 17,000 per well in 100 ul cell culture medium (DMEM+10% FBS). G-CSF mRNA without a miR-122 sequence in the 3'UTR (G-CSF; mouse 3' UTR mRNA sequence shown in SEQ ID NO: 5717; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5716; polyA tail of approximately 140 nucleotides not shown in sequence; 5' cap, Cap1; fully modified with 5-methylcytidine and 1-methylpseudouridine), G-CSF mRNA having a miR-122 sequence in the 3'UTR (G-CSF miR122; mouse 3' UTR mRNA sequence shown in SEQ ID NO: 5024; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5018; polyA tail of approximately 140 nucleotides not shown in sequence; 5' cap, Cap1; fully modified with 5-methylcytidine and 1-methylpseudouridine), G-CSF mRNA having a miR-122 seed sequence in the 3'UTR (G-CSF seed; mouse 3' UTR mRNA sequence shown in SEQ ID NO: 5026; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5020; polyA tail of approximately 140 nucleotides not shown in sequence; 5' cap, Cap1; fully modified with 5-methylcytidine and 1-methylpseudouridine), G-CSF mRNA having a miR-122 sequence without the seed sequence in the 3'UTR (G-CSF seedless; mouse 3' UTR mRNA sequence shown in SEQ ID NO: 5028; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5022; polyA tail of approximately 140 nucleotides not shown in sequence; 5' cap, Cap1; fully modified with 5-methylcytidine and 1-methylpseudouridine), Factor IX mRNA without a miR-122 sequence in the 3'UTR (FIX; mouse 3' UTR mRNA sequence shown in SEQ ID NO: 5719; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5718; polyA tail of approximately 140 nucleotides not shown in sequence; 5' cap, Cap1; fully modified with 5-methylcytidine and 1-methylpseudouridine), Factor IX mRNA having a miR-122 sequence in the 3'UTR (FIX miR122; mouse 3' UTR mRNA sequence shown in SEQ ID NO: 5036; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5030; polyA tail of approximately 140 nucleotides not shown in sequence; 5' cap, Cap1; fully modified with 5-methylcytidine and 1-methylpseudouridine), Factor IX mRNA having a miR-122 seed sequence in the 3'UTR (FIX seed; mouse 3' UTR mRNA sequence shown in SEQ ID NO: 5038; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5032; polyA tail of approximately 140 nucleotides not shown in sequence; 5' cap, Cap1; fully modified with 5-methylcytidine and 1-methylpseudouridine) or Factor IX mRNA having a miR-122 sequence without the seed sequence in the 3'UTR (FIX seedless; mouse 3' UTR mRNA sequence shown in SEQ ID NO: 5040; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5034; polyA tail of approximately 140 nucleotides not shown in sequence; 5' cap, Cap1; fully modified with 5-methylcytidine and 1-methylpseudouridine) were transfected with 0.3 ul per well of Lipofectamine 2000 at a concentration of 75 ng of mRNA per well in 96 well plates. The supernatant was collected between 16-18 hours after transfection, expression of G-CSF or Factor IX was measured by ELISA, and the results are shown in Table 48.

TABLE 48

Expression in HeLa

| Description | Protein Expression Mm 3'UTR (ng/ml) | Protein Expression Hs 3'UTR (ng/ml) |
|---|---|---|
| G-CSF | 271.72 | 69.4 |
| G-CSF miR122 | 305.36 | 68.8 |
| G-CSF seed | 209.5 | 98.0 |
| G-CSF seedless | 243.2 | 80.9 |
| FIX | 249.8 | 131.6 |
| FIX mir122 | 204.6 | 55.4 |
| FIX seed | 290.05 | 127.6 |
| FIX seedless | 180.9 | 31.6 |

B. Primary Human and Rat Hepatocytes

Primary human or rat hepatocytes cells were seeded at a density of 350,000 cells per well in 500 ul cell culture medium (InvitroGRO CP and InVitroGRO HI Medium+ 2.2% Torpedo Antibiotic). G-CSF mRNA without a miR-122 sequence in the 3'UTR (G-CSF; mouse 3' UTR mRNA sequence shown in SEQ ID NO: 5717; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5716; polyA tail of approximately 140 nucleotides not shown in sequence; 5' cap, Cap1; fully modified with 5-methylcytidine and 1-methylpseudouridine), G-CSF mRNA having a miR-122 sequence in the 3'UTR (G-CSF miR122; mouse 3' UTR mRNA sequence shown in SEQ ID NO: 5024; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5018; polyA tail of approximately 140 nucleotides not shown in sequence; 5' cap, Cap1; fully modified with 5-methylcytidine and 1-methylpseudouridine), G-CSF mRNA having a miR-122 seed sequence in the 3'UTR (G-CSF seed; mouse 3' UTR mRNA sequence shown in SEQ ID NO: 5026; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5020; polyA tail of approximately 140 nucleotides not shown in sequence; 5' cap, Cap1; fully modified with 5-methylcytidine and 1-methylpseudouridine), G-CSF mRNA having a miR-122 sequence without the seed sequence in the 3'UTR (G-CSF seedless; mouse 3' UTR mRNA sequence shown in SEQ ID NO: 5028; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5022; polyA tail of approximately 140 nucleotides not shown in sequence; 5' cap, Cap1; fully modified with 5-methylcytidine and 1-methylpseudouridine), Factor IX mRNA without a miR-122 sequence in the 3'UTR (FIX; mouse 3' UTR mRNA sequence shown in SEQ ID NO: 5719; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5718; polyA tail of approximately 140 nucleotides not shown in sequence; 5' cap, Cap1; fully modified with 5-methylcytidine and 1-methylpseudouridine), Factor IX mRNA having a miR-122 sequence in the 3'UTR (FIX miR122; mouse 3' UTR mRNA sequence shown in SEQ ID NO: 5036; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5030; polyA tail of approximately 140 nucleotides not shown in sequence; 5' cap, Cap1; fully modified with 5-methylcytidine and 1-methylpseudouridine), Factor IX mRNA having a miR-122 seed sequence in the 3'UTR (FIX seed; mouse 3' UTR mRNA sequence shown in SEQ ID NO: 5038; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5032; polyA tail of approximately 140 nucleotides not shown in sequence; 5' cap, Cap1; fully modified with 5-methylcytidine and 1-methylpseudouridine) or Factor IX mRNA having a miR-122 sequence without the seed sequence in the 3'UTR (FIX seedless; mouse 3' UTR mRNA sequence shown in SEQ ID NO: 5040; polyA tail of approximately 140 nucleotides not shown in sequence; 5' cap, Cap1; fully modified with 5-methylcytidine and 1-methylpseudouridine; human 3'UTR mRNA sequence shown in SEQ ID NO: 5034; polyA tail of approximately 140 nucleotides not shown in sequence; 5' cap, Cap1; fully modified with 5-methylcytidine and 1-methylpseudouridine) were transfected with 1 ul per well of Lipofectamine 2000 at a concentration of 500 ng per well in 24 well plates for the primary human hepatocytes and the primary rat hepatocytes. The supernatant was collected at 24 hours, 48 hours and 72 hours after transfection, expression of G-CSF and Factor IX was measured by ELISA, and the results are shown in Table 49. The mir-122 binding site sequence in the mRNA dampened the G-CSF and Factor IX protein expression in the primary hepatocytes.

TABLE 49

G-CSF Expression in Hepatocytes

| Description | Time Point | Primary Human Hepatocytes Protein Expression (ng/ml) Mm 3'UTR | Primary Human Hepatocytes Protein Expression (ng/ml) Hs 3'UTR |
|---|---|---|---|
| G-CSF | 24 hours | 43.9 | 84.9 |
|  | 48 hours | 18.8 | 100.4 |
|  | 72 hours | 5.7 | 21.3 |
| G-CSF miR122 | 24 hours | 6.9 | 24.0 |
|  | 48 hours | .7 | 3.03 |
|  | 72 hours | .12 | .88 |
| G-CSF seed | 24 hours | 48.5 | 115.8 |
|  | 48 hours | 25.6 | 96.4 |
|  | 72 hours | 8.2 | 19.2 |
| G-CSF seedless | 24 hours | 31.7 | 113.1 |
|  | 48 hours | 11.7 | 92.9 |
|  | 72 hours | 3.4 | 18.9 |
| FIX | 24 hours | 90.8 | 63.2 |
|  | 48 hours | 159.6 | 124.8 |
|  | 72 hours | 70.5 | 44.3 |
| FIX mir122 | 24 hours | 11.8 | 15.9 |
|  | 48 hours | 5.0 | 4.4 |
|  | 72 hours | 1.0 | .4 |
| FIX seed | 24 hours | 77.2 | 60.2 |
|  | 48 hours | 115.0 | 63.0 |
|  | 72 hours | 41.7 | 20.1 |
| FIX seedless | 24 hours | 69.3 | 53.7 |
|  | 48 hours | 123.8 | 75.0 |
|  | 72 hours | 49.0 | 24.5 |

Example 47

Time Course of Modified Nucleic Acids with a Mir-122 Sequence in Cancer Cells

A. Base Level of miR-122

The base level of mir-122 in Human hepatocytes, rat hepatocytes, human hepatocellular carcinoma cells (Hep3B) and HeLa cells were determined by TAQMAN® analysis using the manufacturers protocol. The levels were normalized to U6 and the results are shown in Table 50.

TABLE 50 miR-122 Levels in Various Cell Types

| Cell Type | miR-122 level (normalized to U6) |
|---|---|
| Human Hepatocytes | 16.8 |
| Rat Hepatocytes | 10.9 |
| Hep3B | 0 |
| HeLa | 0 |

B. Primary Human Hepatocytes and Hep3B Cells

Primary human hepatocytes were seeded at a density of 50,000 cells per well in 100 ul cell culture medium (InvitroGRO CP and InVitroGRO HI Medium+2.2% Torpedo Antibiotic Mix) and Hep3B cells were seeded at a density of 20,000 cells per well in 100 ul cell culture medium MEM+ 10% FBS. G-CSF mRNA without a miR-122 sequence in the 3'UTR (G-CSF; mRNA sequence shown in SEQ ID NO: 5745; polyA tail of approximately 140 nucleotides not shown in sequence; 5' cap, cap1; fully modified with 5-methylcytidine and 1-methylpseudouridine), G-CSF mRNA having a miR-122 sequence in the 3'UTR (G-CSF miR122; mRNA sequence shown in SEQ ID NO: 5018; polyA tail of approximately 140 nucleotides not shown in sequence; 5' cap, cap1; fully modified with 5-methylcytidine and 1-methylpseudouridine), G-CSF mRNA having a miR-122 seed sequence in the 3'UTR (G-CSF seed; mRNA sequence shown in SEQ ID NO: 5020; polyA tail of approximately 140 nucleotides not shown in sequence; 5' cap, cap1; fully modified with 5-methylcytidine and 1-methylpseudouridine) or G-CSF mRNA having a miR-122 sequence without the seed sequence in the 3'UTR (G-CSF seedless; mRNA sequence shown in SEQ ID NO: 5022; polyA tail of approximately 140 nucleotides not shown in sequence; 5' cap, Cap1; fully modified with 5-methylcytidine and 1-methylpseudouridine) were transfected with 0.3 ul per well of Lipofectamine 2000 at a concentration of 75 ng of mRNA per well in 96 well plates for the primary human hepatocytes and the Hep3B cells. The supernatant was collected at 24 hours, 48 hours and 72 hours after transfection, expression of G-CSF was measured by ELISA, and the results are shown in Table 51. The mir-122 binding site sequence in the mRNA dampened the G-CSF protein expression in the primary human hepatocytes but not in the Hep3B cells.

TABLE 51

G-CSF Expression

| Description | Time Point | Primary Human Hepatocytes Protein Expression (ng/ml) Hs 3'UTR | Hep3B Protein Expression (ng/ml) Hs 3'UTR |
|---|---|---|---|
| G-CSF | 24 hours | 76 | 55 |
|  | 48 hours | 12 | 33 |
|  | 72 hours | 6 | 10 |
| G-CSF miR 122 | 24 hours | 32 | 37 |
|  | 48 hours | 1 | 27 |
|  | 72 hours | 0 | 6 |
| G-CSF seed | 24 hours | 75 | 39 |
|  | 48 hours | 11 | 28 |
|  | 72 hours | 4 | 6 |
| G-CSF seedless | 24 hours | 79 | 49 |
|  | 48 hours | 15 | 35 |
|  | 72 hours | 6 | 9 |

Example 48

Time Course of Modified Nucleic Acids with a mir-142 3p Sequence

A. Base Level of miR-143 3p

The base level of miR-142 3p in RAW264.7 cells and HeLa cells were determined by TAQMAN® analysis using the manufacturer's protocol. The levels were normalized to U6 and the results are shown in Table 52.

TABLE 52 miR-142 3p Levels in Various Cell Types

| Cell Type | miR-122 level (normalized to U6) |
|---|---|
| Human Hepatocytes | 16.8 |
| Rat Hepatocytes | 10.9 |
| Hep3B | 0 |
| HeLa | 0 |

B. HeLa and RAW264.7 Cells

HeLa cells were seeded at a density of 17,000 per well in 100 ul cell culture medium DMEM+10% FBS and RAW264.7 cells were seeded at a density of 200,000 per well in 100 ul cell culture medium DMEM+10% FBS. G-CSF mRNA without a miR-142 3p sequence in the 3'UTR (G-CSF; mRNA sequence shown in SEQ ID NO: 5749; polyA tail of approximately 140 nucleotides not shown in sequence; 5' cap, Cap1; fully modified with 5-methylcytidine and 1-methylpseudouridine), G-CSF mRNA having a miR-142 3p sequence in the 3'UTR (G-CSF miR142 3p; mRNA sequence shown in SEQ ID NO: 5750; polyA tail of approximately 140 nucleotides not shown in sequence; 5' cap, Cap1; fully modified with 5-methylcytidine and 1-methylpseudouridine), G-CSF mRNA having a miR-142 3p seed sequence in the 3'UTR (G-CSF seed; mRNA sequence shown in SEQ ID NO: 5751; polyA tail of approximately 140 nucleotides not shown in sequence; 5' cap, cap1; fully modified with 5-methylcytidine and 1-methylpseudouridine) or G-CSF mRNA having a miR-142 3p sequence without the seed sequence in the 3'UTR (G-CSF seedless; mRNA sequence shown in SEQ ID NO: 5752; polyA tail of approximately 140 nucleotides not shown in sequence; 5' cap, Cap1; fully modified with 5-methylcytidine and 1-methylpseudouridine) were transfected with 0.3 ul per well of Lipofectamine 2000 at a concentration of 75 ng of mRNA per well in 96 well plates for HeLa or with 1 ul per well of Lipofectamine 2000 at a concentration of 250 ng of mRNA per well in 24 well plates for RAW264.7 cells. The supernatant was collected 16-18 hours after transfection, expression of G-CSF was measured by ELISA, and the results are shown in Table 53. miR-142 3p sites in G-CSF were shown to down-regulate G-CSF expression in RAW264.7 cells.

TABLE 53

Expression

| Description | HeLa Protein Expression (ng/ml) | RAW264.7 Protein Expression (ng/ml) |
|---|---|---|
| G-CSF | 243.5 | 124.8 |
| G-CSF miR 142 3p | 309.1 | 42.8 |
| G-CSF seed | 259.8 | 148.1 |
| G-CSF seedless | 321.7 | 185.2 |

C. Time Course in RAW264.7 Cells

RAW264.7 cells were seeded at a density of 60,000 cells per well in 100 ul cell culture medium (DMEM+10% FBS). G-CSF mRNA without a miR-142 3p sequence in the 3'UTR (G-CSF; mRNA sequence shown in SEQ ID NO: 5749; polyA tail of approximately 140 nucleotides not shown in sequence; 5' cap, cap1; fully modified with 5-methylcytidine and 1-methylpseudouridine), G-CSF mRNA having a miR-142 3p sequence in the 3'UTR (G-CSF miR142 3p; mRNA sequence shown in SEQ ID NO: 5750; polyA tail of approximately 140 nucleotides not shown in sequence; 5' cap, Cap1; fully modified with 5-methylcytidine and 1-methylpseudouridine), G-CSF mRNA having a miR-142 3p seed sequence in the 3'UTR (G-CSF seed; mRNA sequence shown in SEQ ID NO: 5751; polyA tail of approximately 140 nucleotides not shown in sequence; 5' cap, cap1; fully modified with 5-methylcytidine and 1-methylpseudouridine) or G-CSF mRNA having a miR-142 3p sequence without the seed sequence in the 3'UTR (G-CSF seedless; mRNA sequence shown in SEQ ID NO: 5752; polyA tail of approximately 140 nucleotides not shown in sequence; 5' cap, cap1; fully modified with 5-methylcytidine and 1-methylpseudouridine) were transfected with 0.3 ul per well of Lipofectamine 2000 at a concentration of 75 ng of mRNA per well in 96 well plates. The supernatant was collected at 24 hours, 48 hours and 72 hours after transfection, expression of G-CSF was measured by ELISA, and the results are shown in Table 54. The mir-142 3p binding site sequence in the mRNA showed a strong suppression of G-CSF expression in RAW264.7 cells over time.

TABLE 54

G-CSF Expression

| Description | Time Point | RAW264.7 Cells Protein Expression (ng/ml) |
|---|---|---|
| G-CSF | 24 hours | 133.5 |
|  | 48 hours | 69.7 |
|  | 72 hours | 2.1 |
| G-CSF miR 142 3p | 24 hours | 60.1 |
|  | 48 hours | 9.2 |
|  | 72 hours | .3 |
| G-CSF seed | 24 hours | 244.9 |
|  | 48 hours | 68.9 |
|  | 72 hours | 2.3 |
| G-CSF seedless | 24 hours | 250.2 |
|  | 48 hours | 95.9 |
|  | 72 hours | 3.0 |

D. miR-142 3p in PBMC

Peripheral blood mononuclear cells (PBMCs) were seeded at a density of 150,000 cells per well in 100 ul cell culture medium (Opti-MEM and after transfection add 10% FBS). G-CSF mRNA having a miR-142 3p sequence in the 3'UTR (G-CSF miR142 3p; mRNA sequence shown in SEQ ID NO: 5750; polyA tail of approximately 140 nucleotides not shown in sequence; 5' cap, Cap1; fully modified with 5-methylcytidine and 1-methylpseudouridine), G-CSF mRNA having a miR-142 3p seed sequence in the 3'UTR (G-CSF seed; mRNA sequence shown in SEQ ID NO: 5751; polyA tail of approximately 140 nucleotides not shown in sequence; 5' cap, cap1; fully modified with 5-methylcytidine and 1-methylpseudouridine) or G-CSF mRNA having a miR-142 3p sequence without the seed sequence in the 3'UTR (G-CSF seedless; mRNA sequence shown in SEQ ID NO: 5752; polyA tail of approximately 140 nucleotides not shown in sequence; 5' cap, cap1; fully modified with 5-methylcytidine and 1-methylpseudouridine) were transfected in triplicate with 0.4 ul per well of Lipofectamine 2000 at a concentration of 500 ng of mRNA per well in 96 well plates for 2 or 3 donors. The supernatant was collected at 24 hours after transfection and the expression of G-CSF was measured by ELISA. The results for the 2 donors are shown in Table 55 and the results for the 3 donors are shown in Table 56. The mir-142 3p binding site sequence in the mRNA was shown to down regulate G-CSF expression in human PBMC.

TABLE 55

Expression PBMC (2 donors)

| Description | Protein Expression (ng/ml) |
|---|---|
| G-CSF miR 142 3p | 5.09 |
| G-CSF seed | 10.06 |
| G-CSF seedless | 9.38 |

TABLE 56

Expression PBMC (3 donors)

| Description | Protein Expression (ng/ml) |
|---|---|
| G-CSF miR 142 3p | 7.48 |
| G-CSF seed | 13.40 |
| G-CSF seedless | 13.98 |

Example 49

In Vivo Expression of Modified mRNA

A. BALB/C Nude Mice

BALB/c nude mice were injected intravenously with 0.1 mg/kg luciferase modified mRNA without a miR-122 binding site ("non-targeted mRNA"; mRNA sequence shown in SEQ ID NO: 5753; polyA tail of approximately 140 nucleotides not shown in sequence; 5' cap, Cap1; fully modified with 5-methylcytidine and 1-methylpeudouridine) formulated in a lipid nanoparticle described in Table 57 or luciferase modified mRNA with a miR-122 binding site in the 3'UTR ("miR-122 targeted mRNA"; mRNA sequence shown in SEQ ID NO: 5754; polyA tail of approximately 140 nucleotides not shown in sequence; 5' cap, Cap1; fully modified with 5-methylcytidine and 1-methylpeudouridine) formulated in a lipid nanoparticle described in Table 58.

TABLE 57

Lipid Nanoparticle for Non-targeted mRNA

| LNP | Luciferase: non-targeted mRNA |
|---|---|
| Lipid | DLin-KC2-DMA |
| Lipid/RNA wt/wt | 20 |
| Mean size | 73.3 nm |
|  | PDI: 0.06 |

TABLE 58

Lipid Nanoparticle for Targeted mRNA

| LNP | Luciferase: targeted mRNA |
|---|---|
| Lipid | DLin-KC2-DMA |
| Lipid/RNA wt/wt | 20 |
| Mean size | 70.6 nm |
|  | PDI: 0.08 |

24 hours post-treatment, animals were anesthetized, injected with the luciferase substrate D-luciferin and the bioluminescence imaging (BLI) from living animals was evaluated in an IVIS imager 15 minutes later. Signals were obtained from animals injected with non-targeted mRNA and from miR-122 targeted mRNA, and presented in Table 59. The total light signal produced from livers of animals treated with miR 122 targeted mRNA is 29× lower than non-targeted mRNA, showing that the engineered element in the 3'UTR may inhibit protein expression in normal tissue.

TABLE 59

In vivo expression of modified mRNA modulated by an engineered miR 122 binding site

| Description | Luciferase signal from liver (photons/sec) |
|---|---|
| Non-targeted mRNA | $7.9 \times 10^7$ |
| miR-122 targted mRNA | $2.7 \times 10^6$ |

B. BALB/c Nude Mice with Hepatocellular Carcinoma Hep3B Cells

BALB/c nude mice were intrahepatically implanted with $2\times10^6$ hepatocellular carcinoma Hep3B cells and resulting orthotopic tumors allowed to grow for 24 days. Tumor-bearing mice were then intravenously injected with 0.1 mg/kg luciferase modified mRNA without a miR-122 binding site ("non-targeted mRNA"; mRNA sequence shown in SEQ ID NO: 5753; polyA tail of approximately 140 nucleotides not shown in sequence; 5' cap, Cap1; fully modified with 5-methylcytidine and 1-methylpeudouridine) or luciferase modified mRNA with a miR-122 binding site in the 3'UTR ("miR-122 targeted mRNA"; mRNA sequence shown in SEQ ID NO: 5754; polyA tail of approximately 140 nucleotides not shown in sequence; 5' cap, Cap1; fully modified with 5-methylcytidine and 1-methylpeudouridine) formulated in a lipid nanoparticle described in Table 57 and 58 (above). 24 hr post-treatment animals were anesthetized, injected with the luciferase substrate D-luciferin and bioluminescence imaging (BLI) from living animals was evaluated in an IVIS imager 20 minutes later. Signal from orthotopic tumors compared to adjacent normal liver was quantified, and miR-122-targeted mRNA systemically delivered via lipid nanoparticles achieved over 2-fold enrichment in tumor compared to normal liver.

Example 50

Effect of the Kozak Sequence in Modified Nucleic Acids

HeLa cells were seeded at a density of 15,000 per well in 100 ul cell culture medium DMEM+FBS 10%. G-CSF mRNA having a Kozak sequence (G-CSF Kozak; mRNA sequence shown in SEQ ID NO: 5716; polyA tail of approximately 140 nucleotides not shown in sequence; 5' cap, Cap1; fully modified with 5-methylcytidine and 1-methylpseudouridine), G-CSF mRNA not having a Kozak sequence (G-CSF no Kozak; mRNA sequence shown in SEQ ID NO: 5008; polyA tail of approximately 140 nucleotides not shown in sequence; 5' cap, Cap1; fully modified with 5-methylcytidine and 1-methylpseudouridine), G-CSF mRNA where the −3 position A, upstream of the start codon, was converted to a T, (G-CSF 3t5'; mRNA sequence shown in SEQ ID NO: 5755 (Table 60); polyA tail of approximately 140 nucleotides not shown in sequence; 5' cap, Cap1; fully modified with 5-methylcytidine and 1-methylpseudouridine), G-CSF mRNA where the −9 position A, upstream of the start codon, was converted to a T, (G-CSF 9t5'; mRNA sequence shown in SEQ ID NO: 5756 (Table 60); polyA tail of approximately 140 nucleotides not shown in sequence; 5' cap, Cap1; fully modified with 5-methylcytidine and 1-methylpseudouridine) or G-CSF mRNA where 9 nucleotides upstream of the start codon (AGAGCCACC) were deleted (G-CSF 9del5'; mRNA sequence shown in SEQ ID NO: 5757 (Table 60); polyA tail of approximately 140 nucleotides not shown in sequence; 5' cap, Cap1; fully modified with 5-methylcytidine and 1-methylpseudouridine) and transfected in triplicate at a concentration of 37.5 ng per well in 96 well plates. 24 hours, 48 hours and 72 hours after transfection, the supernatant was collected and expression of G-CSF was measured by ELISA, and the results are shown in Table 61. In Table 60, the start codon in each sequence is underlined. In Table 60, for G-CSF 3t5' the −3 position A, upstream of the start codon is in bold and underlined and for G-CSF 9t5' the −9 position A upstream of the start codon is in bold and underlined.

TABLE 60

G-CSF Sequences

| Description | Sequence | SEQ ID NO |
|---|---|---|
| G-CSF 3t5' | GGGAAAUAAGAGAGAAAAGAAGAGUAAGAAGAAA UAUAAGAGCCUCC<u>AUG</u>GCCGGUCCCGCGACCCAAA GCCCCAUGAAACUUAUGGCCCUGCAGUUGCUGCU UUGGCACUCGGCCCUCUGGACAGUCCAAGAAGCG ACUCCUCUCGGACCUGCCUCAUCGUUGCCGCAGUC AUUCCUUUUGAAGUGUCUGGAGCAGGUGCGAAAG AUUCAGGGCGAUGGAGCCGCACUCCAAGAGAAGC UCUGCGCGACAUACAAACUUUGCCAUCCCGAGGA GCUCGUACUGCUCGGGCACAGCUUGGGGAUUCCC UGGGCUCCUCUCUCGUCCUGUCCGUCGCAGGCUUU GCAGUUGGCAGGGUGCCUUUCCCAGCUCCACUCCG GUUUGUUCUUGUAUCAGGGACUGCUGCAAGCCCU UGAGGGAAUCUCGCCAGAAUUGGGCCCGACGCUG GACACGUUGCAGCUCGACGUGGCGGAUUUCGCAA CAACCAUCUGGCAGCAGAUGGAGGAACUGGGGAU GGCACCCGCGCUGCAGCCCACGCAGGGGGCAAUGC CGGCCUUUGCGUCCGCGUUUCAGCGCAGGGCGGG UGGAGUCCUCGUAGCGAGCCACCUUCAAUCAUUU UUGGAAGUCUCGUACCGGGUGCUGAGACAUCUUG CGCAGCCGUGAUAAUAGGCUGGAGCCUCGGUGGC CAUGCUUCUUGCCCCUUGGGCCUCCCCCCAGCCCC UCCUCCCCUUCCUGCACCCGUACCCCCGUGGUCUU UGAAUAAAGUCUGAGUGGGCGGC | 5755 |
| G-CSF 9t5' | GGGAAAUAAGAGAGAAAAGAAGAGUAAGAAGAAA UAUAUGAGCCACC<u>AUG</u>GCCGGUCCCGCGACCCAAA GCCCCAUGAAACUUAUGGCCCUGCAGUUGCUGCU UUGGCACUCGGCCCUCUGGACAGUCCAAGAAGCG ACUCCUCUCGGACCUGCCUCAUCGUUGCCGCAGUC AUUCCUUUUGAAGUGUCUGGAGCAGGUGCGAAAG AUUCAGGGCGAUGGAGCCGCACUCCAAGAGAAGC UCUGCGCGACAUACAAACUUUGCCAUCCCGAGGA GCUCGUACUGCUCGGGCACAGCUUGGGGAUUCCC UGGGCUCCUCUCUCGUCCUGUCCGUCGCAGGCUUU GCAGUUGGCAGGGUGCCUUUCCCAGCUCCACUCCG GUUUGUUCUUGUAUCAGGGACUGCUGCAAGCCCU UGAGGGAAUCUCGCCAGAAUUGGGCCCGACGCUG GACACGUUGCAGCUCGACGUGGCGGAUUUCGCAA CAACCAUCUGGCAGCAGAUGGAGGAACUGGGGAU GGCACCCGCGCUGCAGCCCACGCAGGGGGCAAUGC CGGCCUUUGCGUCCGCGUUUCAGCGCAGGGCGGG UGGAGUCCUCGUAGCGAGCCACCUUCAAUCAUUU UUGGAAGUCUCGUACCGGGUGCUGAGACAUCUUG CGCAGCCGUGAUAAUAGGCUGGAGCCUCGGUGGC CAUGCUUCUUGCCCCUUGGGCCUCCCCCCAGCCCC UCCUCCCCUUCCUGCACCCGUACCCCCGUGGUCUU UGAAUAAAGUCUGAGUGGGCGGC | 5756 |
| G-CSF 9del5' | GGGAAAUAAGAGAGAAAAGAAGAGUAAGAAGAAA UAUA<u>AUG</u>GCCGGUCCCGCGACCCAAAGCCCCAUGA AACUUAUGGCCCUGCAGUUGCUGCUUUGGCACUC GGCCCUCUGGACAGUCCAAGAAGCGACUCCUCUCG GACCUGCCUCAUCGUUGCCGCAGUCAUUCCUUUU GAAGUGUCUGGAGCAGGUGCGAAAGAUUCAGGGC GAUGGAGCCGCACUCCAAGAGAAGCUCUGCGCGA CAUACAAACUUUGCCAUCCCGAGGAGCUCGUACU GCUCGGGCACAGCUUGGGGAUUCCCUGGGCUCCU CUCUCGUCCUGUCCGUCGCAGGCUUUGCAGUUGG CAGGGUGCUUUCCCAGCUCCACUCCGGUUUGUUC UUGUAUCAGGGACUGCUGCAAGCCCUUGAGGGAA UCUCGCCAGAAUUGGGCCCGACGCUGGACACGUU GCAGCUCGACGUGGCGGAUUUCGCAACAACCAUC UGGCAGCAGAUGGAGGAACUGGGGAUGGCACCCG CGCUGCAGCCCACGCAGGGGGCAAUGCCGGCCUUU GCGUCCGCGUUUCAGCGCAGGGCGGGUGGAGUCC UCGUAGCGAGCCACCUUCAAUCAUUUUUGGAAGU CUCGUACCGGGUGCUGAGACAUCUUGCGCAGCCG UGAUAAUAGGCUGGAGCCUCGGUGGCCAUGCUUC UUGCCCCUUGGGCCUCCCCCAGCCCCUCCUCCCC UUCCUGCACCCGUACCCCCGUGGUCUUUGAAUAA AGUCUGAGUGGGCGGC | 5757 |

TABLE 61

G-CSF Expression

| | 24 hours Protein Expression (ng/ml) | 48 hours Protein Expression (ng/ml) | 72 hours Protein Expression (ng/ml) |
|---|---|---|---|
| G-CSF Kozak | 239.08 | 339.89 | 283.43 |
| G-CSF No Kozak | 399.83 | 544.08 | 437.23 |
| G-CSF 3t5' | 157.39 | 239.67 | 195.20 |
| G-CSF 9t5' | 171.84 | 263.11 | 195.22 |
| G-CSF 9del5' | 308.16 | 563.64 | 397.20 |

Example 51

Effect of Modification of 5'UTR in Modified Nucleic Acids

BJ Fibroblast cells were seeded at a density of 100,000 per well in 500 ul cell culture medium EMEM+FBS 10%. G-CSF mRNA having a synthetic 5'UTR (G-CSF; mRNA sequence shown in SEQ ID NO: 5716; polyA tail of approximately 140 nucleotides not shown in sequence; 5' cap, Cap1; fully modified with 5-methylcytidine and 1-methylpseudouridine) or G-CSF mRNA containing a 5'UTR with five tandem repeats of an 18 nucleotide sequence from the IRES of the GTX gene (GTX G-CSF; mRNA sequence shown in SEQ ID NO: 5758 (Table 62); polyA tail of approximately 140 nucleotides not shown in sequence; 5' cap, Cap1; fully modified with 5-methylcytidine and 1-methylpseudouridine) and transfected in triplicate at a concentration of 250 ng per well in 24 well plates. 24 hours, 48 hours and 72 hours after transfection, the supernatant was collected and expression of G-CSF was measured by ELISA, and the results are shown in Table 63. In Table 62, the start codon is underlined and the five tandem repeats of an 18 nucleotide sequence from the IRES of the GTX gene is bolded and the first, third and fifth tandem repeat of the 18 nucleotide sequence is also underlined.

TABLE 62

GTX G-CSF Sequence

| Description | Sequence | SEQ ID NO |
|---|---|---|
| GTX G-CSF | GGGAAAUUCUGACAUCCGGCGGAAUUCUGACAU CCGGCGGAAUUCUGACAUCCGGCGGAAUUCUGA CAUCCGGCGGAAUUCUGACAUCCGGCGGAAGAC UCACAACCCCAGAAACAGACAUUAAGAGAGAAAA GAAGAGUAAGAAGAAAUAUAAGAGCCACC<u>A</u>UGGC CGGUCCCGCGACCCAAAGCCCCAUGAAACUUAUGG CCCUGCAGUUGCUGCUUUGGCACUCGGCCCUCUGG ACAGUCCAAGAAGCGACUCCUCUCGGACCUGCCUC AUCGUUGCCGCAGUCAUUCCUUUUGAAGUGUCUG GAGCAGGUGCGAAAGAUUCAGGGCGAUGGAGCCG CACUCCAAGAGAAGCUCUGCGCGACAUACAAACU UUGCCAUCCCGAGGAGCUCGUACUGCUCGGGCAC AGCUUGGGGAUUCCCUGGGCUCCUCUCUCGUCCU GUCCGUCGCAGGCUUUGCAGUUGGCAGGGUGCCU UUCCCAGCUCCACUCCGGUUUGUUCUUGUAUCAG GGACUGCUGCAAGCCCUUGAGGGAAUCUCGCCAG AAUUGGGCCCGACGCUGGACACGUUGCAGCUCGA CGUGGCGGAUUUCGCAACAACCAUCUGGCAGCAG AUGGAGGAACUGGGGAUGGCACCCGCGCUGCAGC CCACGCAGGGGGCAAUGCCGGCCUUUGCGUCCGCG UUUCAGCGCAGGGCGGGUGGAGUCCUCGUAGCGA GCCACCUUCAAUCAUUUUUGGAAGUCUCGUACCG GGUGCUGAGACAUCUUGCGCAGCCGUGAUAAUAG | 5758 |

TABLE 62-continued

GTX G-CSF Sequence

| Description | Sequence | SEQ ID NO |
|---|---|---|
| | GCUGGAGCCUCGGUGGCCAUGCUUCUUGCCCCUU GGGCCUCCCCCCAGCCCCUCCUCCCCUUCCUGCAC CCGUACCCCCGUGGUCUUUGAAUAAAGUCUGAGU GGGCGGC | |

TABLE 63

5' UTR

| Time point | G-CSF Protein Expression (ng/ml) | Gtx G-CSF Protein Expression (ng/ml) |
|---|---|---|
| 24 hours | 26.13 | 79.65 |
| 48 hours | 138.75 | 444.81 |
| 72 hours | 55.37 | 198.14 |

Example 53

Effect of Modification of 5'UTR in Modified Nucleic Acids

BJ Fibroblast cells were seeded at a density of 100,000 per well in 500 ul cell culture medium EMEM+FBS 10%. G-CSF mRNA having a synthetic 5'UTR (G-CSF; mRNA sequence shown in SEQ ID NO: 5716; polyA tail of approximately 140 nucleotides not shown in sequence; 5' cap, Cap1; fully modified with 1-methylpseudouridine) or G-CSF mRNA containing a 5'UTR with five tandem repeats of an 18 nucleotide sequence from the IRES of Gtx gene (Gtx G-CSF; mRNA sequence shown in SEQ ID NO: 5758 (Table 62); polyA tail of approximately 140 nucleotides not shown in sequence; 5' cap, Cap1; fully modified with 1-methylpseudouridine) and transfected in triplicate at a concentration of 250 ng per well in 24 well plates. 24 hours, 48 hours and 72 hours after transfection, the supernatant was collected and expression of G-CSF was measured by ELISA, and the results are shown in Table 64.

TABLE 64

5' UTR

| Time point | G-CSF Protein Expression (ng/ml) | Gtx G-CSF Protein Expression (ng/ml) |
|---|---|---|
| 24 hours | 129.10 | 178.68 |
| 48 hours | 569.97 | 1067.62 |
| 72 hours | 325.16 | 738.30 |

Example 54

In Vivo Effect of the Modification of 5'UTR in Nucleic Acids Modified with 5-methylcytidine and 1-methylpseudouridine To study the effect of the modification of the 5'UTR in modified nucleic acids female Balb/c mice (n=3; 12 weeks old; Harlan Laboratories (South Easton, Mass.)) were treated with lipoplexed mRNA.

8 ug of G-CSF mRNA having a synthetic 5'UTR (G-CSF; mRNA sequence shown in SEQ ID NO: 5716; polyA tail of approximately 140 nucleotides not shown in sequence; 5' cap, Cap1; fully modified with 5-methylcytidine and 1-methylpseudouridine) or G-CSF mRNA where 9 nucleotides upstream of the start codon were deleted (G-CSF 9del5'; mRNA sequence shown in SEQ ID NO: 5757 (Table 60); polyA tail of approximately 140 nucleotides not shown in sequence; 5' cap, Cap1; fully modified with 5-methylcytidine and 1-methylpseudouridine) for treatment of 3 mice is diluted with sterile and serum-free DMEM (Life Technologies) to obtain a total volume of 200 ul. A total of 8 ul of Lipofectamine-2000 (LifeTechnologies, 11668019) for the treatment of 3 mice was diluted with sterile and serum-free DMEM (LifeTechnologies, Grand Island, N.Y.; 11965-118) to obtain a total volume of 200 ul. After 5 minutes of incubation, the two solutions were combined and carefully mixed with a pipette. After 20 minutes the formation of mRNA-Lipofectamine-2000 lipoplexes was completed. The lipoplex solution was transferred to a sterile 1 ml syringe (BD Falcon) carrying a 27 gauge injection needle (0.3 mL BD SafetyGlide insulin syringe with 29 G×½ in BD permanently attached needle (Catalog #305935)). The Balb/C mice were placed under a heat lamp for 5 minutes prior to the 100 ul intravenous tail vein injection containing 2 ug of lipoplexed mRNA. 6 hours after injection the mice were anesthesized and bleed for serum collection by cardiac puncture. The serum samples were then run on a G-CSF ELISA (R&D systems catalog #SCS50) and the results are shown in Table 65. The G-CSF mRNA having the 9 nucleotides upstream of the start codon deleted had a higher G-CSF expression level at 6 hours as compared to the G-CSF having a synthetic UTR.

TABLE 65

| | G-CSF Kozak Expression In Vivo | |
|---|---|---|
| Time Point | G-CSF Expression (ng/ml) | G-CSF 9del5' Expression (ng/ml) |
| 6 hours | 256.2 | 752.4 |

Example 55

In Vivo Effect of the GTX Modification of 5'UTR in G-CSF Nucleic Acids Modified with 5-methylcytidine and 1-methylpseudouridine To study the effect of the modification of the 5'UTR in modified nucleic acids female Balb/c mice (n=3; 12 weeks old; Harlan Laboratories (South Easton, Mass.)) were treated with lipoplexed mRNA.

8 ug of G-CSF mRNA having a synthetic 5'UTR (G-CSF; mRNA sequence shown in SEQ ID NO: 5716; polyA tail of approximately 140 nucleotides not shown in sequence; 5' cap, Cap1; fully modified with 5-methylcytidine and 1-methylpseudouridine) or G-CSF mRNA containing a 5'UTR with five tandem repeats of an 18 nucleotide sequence from the IRES of GTX gene (GTX G-CSF; mRNA sequence shown in SEQ ID NO: 5758 (Table 62); polyA tail of approximately 140 nucleotides not shown in sequence; 5' cap, Cap1; fully modified with 5-methylcytidine and 1-methylpseudouridine) for treatment of 3 mice is diluted with sterile and serum-free DMEM (Life Technologies) to obtain a total volume of 200 ul. A total of 8 ul of Lipofectamine-2000 (LifeTechnologies, 11668019) for the treatment of 3 mice was diluted with sterile and serum-free DMEM (LifeTechnologies, Grand Island, N.Y.; 11965-118) to obtain a total volume of 200 ul. After 5 minutes of incubation, the two solutions were combined and carefully mixed with a pipette. After 20 minutes the formation of mRNA-Lipofectamine-2000 lipoplexes was completed. The lipoplex solution was transferred to a sterile 1 ml syringe (BD Falcon) carrying a 27 gauge injection needle (0.3 mL BD SafetyGlide insulin syringe with 29 G×½ in BD permanently attached needle (Catalog #305935)). The Balb/C mice were placed under a heat lamp for 5 minutes prior to the 100 ul intravenous tail vein injection containing 2 ug of lipoplexed mRNA. 6 hours after injection the mice were anesthesized and bleed for serum collection by cardiac puncture. The serum samples were then run on a G-CSF ELISA (R&D systems catalog #SCS50) and the results are shown in Table 66. The G-CSF mRNA having five tandem repeats of an 18 nucleotide sequence from the IRES of GTX gene had a higher G-CSF expression level at 6 hours as compared to the G-CSF having a synthetic UTR.

TABLE 66

| | GTX G-CSF Expression In Vivo | |
|---|---|---|
| Time Point | G-CSF Expression (ng/ml) | GTX G-CSF Expression (ng/ml) |
| 6 hours | 266.4 | 1284.4 |

Example 56

In Vivo Effect of the GTX Modification of 5'UTR in G-CSF Nucleic Acids Modified with 1-Methylpseudouridine To study the effect of the modification of the 5'UTR in modified nucleic acids female Balb/c mice (n=3; 12 weeks old; Harlan Laboratories (South Easton, Mass.)) were treated with lipoplexed mRNA.

8 ug of G-CSF mRNA having a synthetic 5'UTR (G-CSF; mRNA sequence shown in SEQ ID NO: 5716; polyA tail of approximately 140 nucleotides not shown in sequence; 5' cap, Cap1; fully modified with 1-methylpseudouridine) or G-CSF mRNA containing a 5'UTR with five tandem repeats of an 18 nucleotide sequence from the IRES of GTX gene (GTX G-CSF; mRNA sequence shown in SEQ ID NO: 5758 (Table 62); polyA tail of approximately 140 nucleotides not shown in sequence; 5' cap, Cap1; fully modified with 1-methylpseudouridine) for treatment of 3 mice is diluted with sterile and serum-free DMEM (Life Technologies) to obtain a total volume of 200 ul. A total of 8 ul of Lipofectamine-2000 (LifeTechnologies, 11668019) for the treatment of 3 mice was diluted with sterile and serum-free DMEM (LifeTechnologies, Grand Island, N.Y.; 11965-118) to obtain a total volume of 200 ul. After 5 minutes of incubation, the two solutions were combined and carefully mixed with a pipette. After 20 minutes the formation of mRNA-Lipofectamine-2000 lipoplexes was completed. The lipoplex solution was transferred to a sterile 1 ml syringe (BD Falcon) carrying a 27 gauge injection needle (0.3 mL BD SafetyGlide insulin syringe with 29 G×½ in BD permanently attached needle (Catalog #305935)). The Balb/C mice were placed under a heat lamp for 5 minutes prior to the 100 ul intravenous tail vein injection containing 2 ug of lipoplexed mRNA. 6 hours after injection the mice were anesthesized and bleed for serum collection by cardiac puncture. The serum samples were then run on a G-CSF ELISA (R&D systems catalog #SCS50) and the results are shown in Table 67. The G-CSF mRNA having five tandem repeats of an 18 nucleotide sequence from the IRES of GTX gene had a higher G-CSF expression level at 6 hours as compared to the G-CSF having a synthetic UTR.

TABLE 67

GTX G-CSF Expression In Vivo

| Time Point | G-CSF Expression (ng/ml) | GTX G-CSF Expression (ng/ml) |
|---|---|---|
| 6 hours | 5638.2 | 6281.1 |

Other Embodiments

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, databases, database entries, other references and art mentioned herein are incorporated by reference in their entirety, even if not expressly stated in the citation. In case of conflict, the present specification, including definitions, will control. In addition, section headings, the materials, methods, and examples are illustrative only and not intended to be limiting.

SEQUENCE LISTING (5758 sequences)

SEQ ID NO: 1 - DNA, 10 bp, Homo sapiens
tttttctttt

SEQ ID NO: 2 - DNA, 11 bp, Homo sapiens
ttttgcttttt

SEQ ID NO: 3 - DNA, 10 bp, Homo sapiens
ttttgctttt

SEQ ID NO: 4 - DNA, 11 bp, Homo sapiens
aaaaagcaaaa

SEQ ID NO: 5 - DNA, 47 bp, Homo sapiens
gggaaataagagagaaaagaagagtaagaagaaatataagagccacc

SEQ ID NO: 6 - DNA, 47 bp, Homo sapiens
gggagatcagagagaaaagaagagtaagaagaaatataagagccacc

SEQ ID NO: 7 - DNA, 145 bp, Homo sapiens
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 8 - RNA, 42 nt, Homo sapiens
gggagacaagcuuggcauuccgguacuguugguaaagccacc

SEQ ID NO: 9 - DNA, 371 bp, Homo sapiens
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 10 - DNA, 568 bp, Homo sapiens
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 11 - DNA, 289 bp, Homo sapiens
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 12 - DNA, 379 bp, Homo sapiens
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 13 - DNA, 118 bp, Mus sp.
gctgccttctgcggggcttgccttctggccatgcccttcttctctcccttgcacctgtacctcttggtctttgaataaagcctgagtaggaaggcggccgctcgagcatgcatctaga

SEQ ID NO: 14 - DNA, 908 bp, Homo sapiens
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 15 - DNA, 835 bp, Homo sapiens
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 16 - DNA, 297 bp, Homo sapiens
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 17 - DNA, 602 bp, Homo sapiens
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 18 - DNA, 785 bp, Homo sapiens
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 19 - DNA, 3001 bp, Homo sapiens
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 20 - DNA, 1037 bp, Homo sapiens
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 21 - DNA, 577 bp, Homo sapiens
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 22 - DNA, 2212 bp, Homo sapiens
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 23 - DNA, 729 bp, Homo sapiens
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 24 - DNA, 847 bp, Homo sapiens
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 25 - DNA, 110 bp, Homo sapiens
gctggagcctcggtggccatgcttcttgccccttgggcctccccccagcccctcctccccttcctgcacccgtacccccgtggtctttgaataaagtctgagtgggcggc

SEQ ID NO: 26 - DNA, 27 bp, Homo sapiens
ttggaccctcgtacagaagctaatacg

SEQ ID NO: 27 - DNA, 189 bp, Homo sapiens
ttttttttttttttttttttttttttttttttttttttttttttttttttttttttttttttttttttttttttttttttttttttttttttttttttttttttttttttttttttttttttttttttttttttttttttttttttttttttttttttttcttcctactcaggctttattcaaagacca

SEQ ID NO: 28 - DNA, 20 bp, Homo sapiens
ccttgaccttctggaacttc

SEQ ID NO: 29 - DNA, 20 bp, Homo sapiens
ccaagcactgaaacggatat

SEQ ID NO: 30 - DNA, 20 bp, Homo sapiens
gatgaaaagtgctccaagga

SEQ ID NO: 31 - DNA, 20 bp, Homo sapiens
aaccgtgatgaaaaggtacc

SEQ ID NO: 32 - DNA, 20 bp, Homo sapiens
tcatgcagattggaaaggtc

SEQ ID NO: 33 - DNA, 20 bp, Homo sapiens
cttcttggactgtccagagg

SEQ ID NO: 34 - DNA, 20 bp, Homo sapiens
gcagtccctgatacaagaac

SEQ ID NO: 35 - DNA, 20 bp, Homo sapiens
gattgaaggtggctcgctac

SEQ ID NO: 36 - DNA, 75 bp, Homo sapiens
atgatgccatcctcagtctcatggggtattttgctcttggcgggtctgtgctgtctcgtgccggtgtcgctcgca

SEQ ID NO: 37 - DNA, 90 bp, Homo sapiens
atggccggaccggcgactcagtcgcccatgaaactcatggccctgcagttgttgctttggcactcagccctctggaccgtccaagaggcg

SEQ ID NO: 38 - DNA, 137 bp, Homo sapiens
atgcagagagtgaacatgattatggccgagtccccatcgctcatcacaatctgcctgcttggtacctgctttccgccgaatgcactgtctttctggatcacgagaatgcgaataagatcttgaaccgacccaaacgg

SEQ ID NO: 39 - DNA, 63 bp, Homo sapiens
atgaaaggatcattgctgttgctcctcgtgtcgaaccttctgctttgccagtccgtagccccc

SEQ ID NO: 40 - DNA, 72 bp, Homo sapiens
atgaaatgggtgacgttcatctcactgttgtttttgttctcgtccgcctactccaggggagtattccgccga

SEQ ID NO: 41 - DNA, 63 bp, Homo sapiens
atgtggtggcggctctggtggctgctcctgttgctcctcttgctgtggcccatggtgtgggca

SEQ ID NO: 42 - DNA, 95 bp, Homo sapiens
tgctctttaacctccgcatcctgttgaataacgctgcgttccgaaatgggcataacttcatggtacgcaacttcagatgcggccagccactccag

SEQ ID NO: 43 - DNA, 87 bp, Homo sapiens
atgtccgtcttgacacccctgctcttgagagggctgacggggtccgctagacgcctgccggtaccgcgagcgaagatccactccctg

SEQ ID NO: 44 - DNA, 87 bp, Homo sapiens
atgagcgtgctcactccgttgcttcttcgagggcttacgggatcggctcggaggttgcccgtcccgagagcgaagatccattcgttg

SEQ ID NO: 45 - DNA, 175 bp, Artificial Sequence
  Description of Artificial Sequence:
tgacaaaaataactttatctccccagaattttagaatccaaaaacaggaaaccacactactaaaagaaaaatcaaccgagaaaaattctttagcaaaaagtattctcgcagtaaaaatcacttcatcgaattaaggtcaaaattatcggaacgttttatttcgcataagaacact

SEQ ID NO: 46 - DNA, 69 bp, Artificial Sequence
  Description of Artificial Sequence: Viral Signal Sequenc
atgctgagctttgtggatacccgcaccctgctgctgctggcggtgaccagctgcctggcgacctgccag

SEQ ID NO: 47 - DNA, 96 bp, Artificial Sequence
  Description of Artificial Sequence: Viral Signal Sequence
atgggcagcagccaggcgccgcgcatgggcagcgtgggcggccatggcctgatggcgctgctgatggcgggcctgattctgccgggcattctggcg

SEQ ID NO: 48 - DNA, 51 bp, Artificial Sequence
  Description of Artificial Sequence: Viral Signal Sequence
atggcgggcattttttattttctgtttagctttctgtttggcatttgcgat

SEQ ID NO: 49 - DNA, 66 bp, Artificial Sequence
  Description of Artificial Sequence: Viral Signal Sequence
atggaaaaccgcctgctgcgcgtgtttctggtgtgggcggcgctgaccatggatggcgcgagcgcg

SEQ ID NO: 50 - DNA, 81 bp, Artificial Sequence
  Description of Artificial Sequence: Viral Signal Sequence
atggcgcgccagggctgctttggcagctatcaggtgattagcctgtttacctttgcgattggcgtgaacctgtgcctgggc

SEQ ID NO: 51 - DNA, 57 bp, Artificial Sequence
  Description of Artificial Sequence: Bacterial Signal Sequence
atgagccgcctgccggtgctgctgctgctgcagctgctggtgcgcccgggcctgcag

SEQ ID NO: 52 - DNA, 87 bp, Artificial Sequence
  Description of Artificial Sequence: Bacterial Signal Sequence
atgaaacagcagaaacgcctgtatgcgcgcctgctgaccctgctgtttgcgctgatttttctgctgccgcatagcagcgcgagcgcg

SEQ ID NO: 53 - DNA, 78 bp, Homo sapiens
atggcgacgccgctgcctccgccctccccgcggcacctgcggctgctgcggctgctgctctccgccctcgtcctcggc

SEQ ID NO: 54 - DNA, 54 bp, Homo sapiens
atgaaggctccgggtcggctcgtgctcatcatcctgtgctccgtggtcttctct

SEQ ID NO: 55 - DNA, 45 bp, Homo sapiens
atgcttcagctttggaaacttgttctcctgtgcggcgtgctcact

SEQ ID NO: 56 - DNA, 39 bp, Homo sapiens
atgctttatctccagggttggagcatgcctgctgtggca

SEQ ID NO: 57 - DNA, 144 bp, Homo sapiens
atggataacgtgcagccgaaaataaaacatcgccccttctgcttcagtgtgaaaggccacgtgaagatgctgcggctggatattatcaactcactggtaacaacagtattcatgctcatcgtatctgtgttggcactgatacca

SEQ ID NO: 58 - DNA, 96 bp, Homo sapiens
atgccctgcctagaccaacagctcactgttcatgccctaccctgccctgcccagccctcctctctggccttctgccaagtggggttcttaacagca

SEQ ID NO: 59 - DNA, 138 bp, Homo sapiens
atgaaaaccttgttcaatccagcccctgccattgctgacctggatccccagttctacaccctctcagatgtgttctgctgcaatgaaagtgaggctgagattttaactggcctcacggtgggcagcgctgcagatgct

SEQ ID NO: 60 - DNA, 57 bp, Homo sapiens
atgaagcctctccttgttgtgtttgtctttcttttcctttgggatccagtgctggca

SEQ ID NO: 61 - DNA, 63 bp, Homo sapiens
atgtcctgttccctaaagtttactttgattgtaatttttttttactgttggctttcatccagc

SEQ ID NO: 62 - DNA, 210 bp, Homo sapiens
atggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggt

SEQ ID NO: 63 - DNA, 96 bp, Homo sapiens
atggccaccccgccattccggctgataaggaagatgttttccttcaaggtgagcagatggatggggcttgcctgcttccggtccctggcggcatcc

SEQ ID NO: 64 - DNA, 87 bp, Homo sapiens
atgagctttttccaactcctgatgaaaaggaaggaactcattcccttggtggtgttcatgactgtggcggcgggtggagcctcatct

SEQ ID NO: 65 - DNA, 123 bp, Homo sapiens
atggtctcagctctgcggggagcacccctgatcagggtgcactcaagccctgtttcttctccttctgtgagtggaccacggaggctggtgagctgcctgtcatcccaaagctcagctctgagc

SEQ ID NO: 66 - DNA, 60 bp, Homo sapiens
atgatggggtccccagtgagtcatctgctggccggcttctgtgtgtgggtcgtcttgggc

SEQ ID NO: 67 - DNA, 69 bp, Homo sapiens
atggcaagcatggctgccgtgctcacctgggctctggctcttctttcagcgttttcggccacccaggca

SEQ ID NO: 68 - DNA, 135 bp, Homo sapiens
atggtgctcatgtggaccagtggtgacgccttcaagacggcctacttcctgctgaagggtgcccctctgcagttctccgtgtgcggcctgctgcaggtgctggtggacctggccatcctggggcaggcctacgcc

SEQ ID NO: 69 - DNA, 204 bp, Homo sapiens
atggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttcc

SEQ ID NO: 70 - DNA, 147 bp, Homo sapiens
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagcc

SEQ ID NO: 71 - DNA, 45 bp, Homo sapiens
atgggtctgctccttcccctggcactctgcatcctagtcctgtgc

SEQ ID NO: 72 - DNA, 78 bp, Homo sapiens
atggggatccagacgagccccgtcctgctggcctccctgggggtggggctggtcactctgctcggcctggctgtgggc

SEQ ID NO: 73 - DNA, 75 bp, Homo sapiens
atgtcggacctgctactactgggcctgattgggggcctgactctcttactgctgctgacgctgctagcctttgcc

SEQ ID NO: 74 - DNA, 87 bp, Homo sapiens
atggagactgtggtgattgttgccataggtgtgctggccaccatgtttctggcttcgtttgcagccttggtgctggtttgcaggcag

SEQ ID NO: 75 - DNA, 105 bp, Homo sapiens
atgcgcggctctgtggagtgcacctggggttgggggcactgtgcccccagccccctgctcctttggactctacttctgtttgcagccccatttggcctgctgggg

SEQ ID NO: 76 - DNA, 171 bp, Homo sapiens
atgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcc

SEQ ID NO: 77 - DNA, 108 bp, Homo sapiens
atggccctgccccagatgtgtgacgggagccacttggcctccaccctccgctattgcatgacagtcagcggcacagtggttctggtggccgggacgctctgcttcgct

SEQ ID NO: 78 - DNA, 63 bp, Artificial Sequence
  Description of Artificial Sequence: Bacterial Signal Sequence
tgaaaaagtggttcgttgctgccggcatcggcgctgccggactcatgctctccagcgccgcca

SEQ ID NO: 79 - DNA, 63 bp, Artificial Sequence
  Description of Artificial Sequence: Bacterial Signal Sequence
atgaaacagagcaccattgcgctggcgctgctgccgctgctgtttaccccggtgaccaaagcg

SEQ ID NO: 80 - DNA, 63 bp, Artificial Sequence
  Description of Artificial Sequence: Bacterial Signal Sequence
atgaaaaaaaccgcgattgcgattgcggtggcgctggcgggctttgcgaccgtggcgcaggcg

SEQ ID NO: 81 - DNA, 63 bp, Artificial Sequence
  Description of Artificial Sequence: Bacterial Signal Sequence
atgaaaaaactgatgctggcgattttttttagcgtgctgagctttccgagctttagccagagc

SEQ ID NO: 82 - DNA, 69 bp, Artificial Sequence
  Description of Artificial Sequence: Bacterial Signal Sequence
atgaaaaaaaacattgcgtttctgctggcgagcatgtttgtgtttagcattgcgaccaacgcgtatgcg

SEQ ID NO: 83 - DNA, 96 bp, Homo sapiens
atgtttgcgaaacgctttaaaaccagcctgctgccgctgtttgcgggctttctgctgctgtttcatctggtgctggcgggcccggcggcggcgagc

SEQ ID NO: 84 - DNA, 57 bp, Homo sapiens
atgcgctttccgagcatttttaccgcggtgctgtttgcggcgagcagcgcgctggcg

SEQ ID NO: 85 - DNA, 57 bp, Homo sapiens
atgcgctttccgagcatttttaccaccgtgctgtttgcggcgagcagcgcgctggcg

SEQ ID NO: 86 - DNA, 57 bp, Homo sapiens
atgcgctttccgagcatttttaccagcgtgctgtttgcggcgagcagcgcgctggcg

SEQ ID NO: 87 - DNA, 57 bp, Homo sapiens
atgcgctttccgagcatttttacccatgtgctgtttgcggcgagcagcgcgctggcg

SEQ ID NO: 88 - DNA, 57 bp, Homo sapiens
atgcgctttccgagcatttttaccattgtgctgtttgcggcgagcagcgcgctggcg

SEQ ID NO: 89 - DNA, 57 bp, Homo sapiens
atgcgctttccgagcatttttacctttgtgctgtttgcggcgagcagcgcgctggcg

SEQ ID NO: 90 - DNA, 57 bp, Homo sapiens
atgcgctttccgagcatttttaccgaagtgctgtttgcggcgagcagcgcgctggcg

SEQ ID NO: 91 - DNA, 57 bp, Homo sapiens
atgcgctttccgagcatttttaccggcgtgctgtttgcggcgagcagcgcgctggcg

SEQ ID NO: 92 - DNA, 63 bp, Homo sapiens
atgcgttcctcccccctcctccgctccgccgttgtggccgccctgccggtgttggcccttgcc

SEQ ID NO: 93 - DNA, 66 bp, Homo sapiens
atgggcgcggcggccgtgcgctggcacttgtgcgtgctgctggccctgggcacacgcgggcggctg

SEQ ID NO: 94 - DNA, 53 bp, Artificial Sequence
  Description of Artificial Sequence: Signal Sequence
atgaggagctcccttgtgctgttctttgtctctgcgtggacggccttggccag

SEQ ID NO: 95 - DNA, 96 bp, Homo sapiens
atgctcaggggtccgggacccgggcggctgctgctgctagcagtcctgtgcctggggacatcggtgcgctgcaccgaaaccgggaagagcaagagg

SEQ ID NO: 96 - DNA, 69 bp, Homo sapiens
atgcttaggggtccggggcccgggctgctgctgctggccgtccagctggggacagcggtgccctccacg

SEQ ID NO: 97 - DNA, 93 bp, Homo sapiens
atgcgccggggggccctgaccgggctgctcctggtcctgtgcctgagtgttgtgctacgtgcagccccctctgcaacaagcaagaagcgcagg

SEQ ID NO: 98 - protein, 24 aa, Homo sapiens
MMPSSVSWGILLAGLCCLVPVSLA

SEQ ID NO: 99 - protein, 30 aa, Homo sapiens
MAGPATQSPMKLMALQLLLWHSALWTVQEA

SEQ ID NO: 100 - protein, 46 aa, Homo sapiens
MQRVNMIMAESPSLITICLLGYLLSAECTVFLDHENANKILNRPKR

SEQ ID NO: 101 - protein, 21 aa, Homo sapiens
MKGSLLLLLVSNLLLCQSVAP

SEQ ID NO: 102 - protein, 24 aa, Homo sapiens
MKWVTFISLLFLFSSAYSRGVFRR

SEQ ID NO: 103 - protein, 19 aa, Homo sapiens
MWWRLWWLLLLLLLLPMWA

SEQ ID NO: 104 - protein, 32 aa, Homo sapiens
MLFNLRILLNNAAFRNGHNFMVRNFRCGQPLQ

SEQ ID NO: 105 - protein, 29 aa, Homo sapiens
MSVLTPLLLRGLTGSARRLPVPRAKIHSL

SEQ ID NO: 106 - protein, 29 aa, Homo sapiens
MSVLTPLLLRGLTGSARRLPVPRAKIHSL

SEQ ID NO: 107 - protein, 59 aa, Artificial Sequence
  Description of Artificial Sequence: Bacterial Signal Sequence
VTKITLSPQNFRIQKQETTLLKEKSTEKNSLAKSILAVKNHFIELRSKLSERFISHKNT

SEQ ID NO: 108 - protein, 23 aa, Artificial Sequence
  Description of Artificial Sequence: Viral Signal Sequence
MLSFVDTRTLLLLAVTSCLATCQ

SEQ ID NO: 109 - protein, 32 aa, Artificial Sequence
  Description of Artificial Sequence: Viral Signal Sequence
MGSSQAPRMGSVGGHGLMALLMAGLILPGILA

SEQ ID NO: 110 - protein, 17 aa, Artificial Sequence
  Description of Artificial Sequence: Viral Signal Sequence
MAGIFYFLFSFLFGICD

SEQ ID NO: 111 - protein, 22 aa, Artificial Sequence
  Description of Artificial Sequence: Viral Signal Sequence
MENRLLRVFLVWAALTMDGASA

SEQ ID NO: 112 - protein, 27 aa, Artificial Sequence
  Description of Artificial Sequence: Viral Signal Sequence
MARQGCFGSYQVISLFTFAIGVNLCLG

SEQ ID NO: 113 - protein, 19 aa, Artificial Sequence
  Description of Artificial Sequence: Bacterial Signal Sequence
MSRLPVLLLLQLLVRPGLQ

SEQ ID NO: 114 - protein, 29 aa, Artificial Sequence
  Description of Artificial Sequence: Bacterial Signal Sequence
MKQQKRLYARLLTLLFALIFLLPHSSASA

SEQ ID NO: 115 - protein, 22 aa, Homo sapiens
MATPLPPPSPRHLRLLRLLLSG

SEQ ID NO: 116 - protein, 18 aa, Homo sapiens
MKAPGRLVLIILCSVVFS

SEQ ID NO: 117 - protein, 13 aa, Homo sapiens
MLQLWKLLCGVLT

SEQ ID NO: 118 - protein, 13 aa, Homo sapiens
MLYLQGWSMPAVA

SEQ ID NO: 119 - protein, 48 aa, Homo sapiens
MDNVQPKIKHRPFCFSVKGHVKMLRLDIINSLVTTVFMLIVSVLALIP

SEQ ID NO: 120 - protein, 32 aa, Homo sapiens
MPCLDQQLTVHALPCPAQPSSLAFCQVGFLTA

SEQ ID NO: 121 - protein, 46 aa, Homo sapiens
MKTLFNPAPAIADLDPQFYTLSDVFCCNESEAEILTGLTVGSAADA

SEQ ID NO: 122 - protein, 19 aa, Homo sapiens
MKPLLVVFVFLFLWDPVLA

SEQ ID NO: 123 - protein, 21 aa, Homo sapiens [sequence omitted]

SEQ ID NO: 124 - protein, 70 aa, Homo sapiens
MVLTKPLQRNGSMMSFENVKEKSREGGPHAHTPEEELCFVVTHTPQVQTTLNLFFHIFKVLTQPLSLLWG

SEQ ID NO: 125 - protein, 32 aa, Homo sapiens
MATPPFRLIRKMFSFKVSRWMGLACFRSLAAS

SEQ ID NO: 126 - protein, 29 aa, Homo sapiens
MSFFQLLMKRKELIPLVVFMTVAAGGASS

SEQ ID NO: 127 - protein, 41 aa, Homo sapiens
MVSALRGAPLIRVHSSPVSSPSVSGPAALVSCLSSQSSALS

SEQ ID NO: 128 - protein, 20 aa, Homo sapiens
MMGSPVSHLLAGFCVWVVLG

SEQ ID NO: 129 - protein, 23 aa, Homo sapiens
MASMAAVLTWALALLSAFSATQA

SEQ ID NO: 130 - protein, 45 aa, Homo sapiens
MVLMWTSGDAFKTAYFLLKGAPLQFSVCGLLQVLVDLAILGQATA

SEQ ID NO: 131 - protein, 68 aa, Homo sapiens
MDFVAGAIGGVCGVAVGYPLDTVKVRIQTEPLYTGIWHCVRDTYHRERVWGFYRGLSLPVCTVSLVSS

SEQ ID NO: 132 - protein, 49 aa, Homo sapiens
MEKPLFPLVPLHWFGFGYTALVVSGGIVGYVKTGSVPSLAAGLLFGSLA

SEQ ID NO: 133 - protein, 15 aa, Homo sapiens
MGLLLPLALCILVLC

SEQ ID NO: 134 - protein, 26 aa, Homo sapiens
MGIQTSPVLLASLGVGLVTLLGLAVG

SEQ ID NO: 135 - protein, 25 aa, Homo sapiens
MSDLLLLGLIGGLTLLLLLTLLAFA

SEQ ID NO: 136 - protein, 29 aa, Homo sapiens
METVVIVAIGVLATIFLASFAALVLVCRQ

SEQ ID NO: 137 - protein, 35 aa, Homo sapiens
MAGSVECTWGWGHCAPSPLLLWTLLLFAAPFGLLG

SEQ ID NO: 138 - protein, 57 aa, Homo sapiens
MMPSRTNLATGIPSSKVKYSRLSSTDDGYIDLQFKKTPPKIPYKAIALATVLFLIGA

SEQ ID NO: 139 - protein, 36 aa, Homo sapiens
MALPQMCDGSHLASTLRYCMTVSGTVVLVAGTLCFA

SEQ ID NO: 140 - protein, 21 aa, Homo sapiens
MKKWFVAAGIGAGLLMLSSAA

SEQ ID NO: 141 - protein, 21 aa, Homo sapiens
MKQSTIALALLPLLFTPVTKA

SEQ ID NO: 142 - protein, 21 aa, Homo sapiens
MKKTAIAIAVALAGFATVAQA

SEQ ID NO: 143 - protein, 21 aa, Artificial Sequence
  Description of Artificial Sequence: Bacterial Signal Sequence
MKKLMLAIFFSVLSFPSFSQS

SEQ ID NO: 144 - protein, 23 aa, Artificial Sequence
  Description of Artificial Sequence: Bacterial Signal Sequence
MKKNIAFLLASMFVFSIATNAYA

SEQ ID NO: 145 - protein, 32 aa, Homo sapiens
MFAKRFKTSLLPLFAGFLLLFHLVLAGPAAAS

SEQ ID NO: 146 - protein, 19 aa, Homo sapiens
MRFPSIFTAVLFAASSALA

SEQ ID NO: 147 - protein, 19 aa, Homo sapiens
MRFPSIFTTVLFAASSALA

SEQ ID NO: 148 - protein, 19 aa, Homo sapiens
MRFPSIFTSVLFAASSALA

SEQ ID NO: 149 - protein, 19 aa, Homo sapiens
MRFPSIFTHVLFAASSALA

SEQ ID NO: 150 - protein, 19 aa, Homo sapiens
MRFPSIFTIVLFAASSALA

SEQ ID NO: 151 - protein, 19 aa, Homo sapiens
MRFPSIFTFVLFAASSALA

SEQ ID NO: 152 - protein, 19 aa, Homo sapiens
MRFPSIFTEVLFAASSALA

SEQ ID NO: 153 - protein, 19 aa, Homo sapiens
MRFPSIFTGVLFAASSALA

SEQ ID NO: 154 - protein, 21 aa, Homo sapiens
MRSSPLLRSAVVAALPVLALA

SEQ ID NO: 155 - protein, 22 aa, Homo sapiens
MGAAAVRWHLCVLLALGTRGRL

SEQ ID NO: 156 - protein, 17 aa, Artificial Sequence
  Description of Artificial Sequence: Signal Sequence
MRSSLVLFFVSAWTALA

SEQ ID NO: 157 - protein, 32 aa, Homo sapiens
MLRGPGPGRLLLLAVLCLGTSVRCTETGKSKR

SEQ ID NO: 158 - protein, 26 aa, Homo sapiens
MLRGPGPGLLLLAVQCLGTAVPSTGA

SEQ ID NO: 159 - protein, 31 aa, Homo sapiens
MRRGALTGLLLVLCLSVVLRAAPSATSKKRR

SEQ ID NO: 160 - protein, 4 aa, Homo sapiens
  MOD_RES (2)..(3): Xaa = Any amino acid
RXXR

SEQ ID NO: 161 - protein, 4 aa, Homo sapiens
  MOD_RES (2)..(2): Xaa = Any amino acid
  MOD_RES (3)..(3): Xaa = Lys or Arg
RXXR

SEQ ID NO: 162 - protein, 6 aa, Homo sapiens
  MOD_RES (1)..(1): Xaa = Lys or Arg
  MOD_RES (2)..(5): Xaa = Any amino acid
  MOD_RES (6)..(6): Xaa = Lys or Arg
XXXXXX

SEQ ID NO: 163 - protein, 8 aa, Homo sapiens
  MOD_RES (1)..(1): Xaa = Lys or Arg
  MOD_RES (2)..(7): Xaa = Any amino acid
  MOD_RES (8)..(8): Xaa = Lys or Arg
XXXXXXXX

SEQ ID NO: 164 - protein, 6 aa, Homo sapiens
LVPRGS

SEQ ID NO: 165 - protein, 4 aa, Homo sapiens
LVPR

SEQ ID NO: 166 - protein, 4 aa, Homo sapiens
  MOD_RES (1)..(1): Xaa = Ala, Phe, Gly, Ile, Leu, Thr, Val or Met
  MOD_RES (2)..(2): Xaa = Ala, Phe, Gly, Ile, Leu, Thr, Val or Trp
XXPR

SEQ ID NO: 167 - protein, 4 aa, Homo sapiens
IEGR

SEQ ID NO: 168 - protein, 4 aa, Homo sapiens
IDGR

SEQ ID NO: 169 - protein, 4 aa, Homo sapiens
AEGR

SEQ ID NO: 170 - protein, 4 aa, Homo sapiens
  MOD_RES (1)..(1): Xaa = Ala, Phe, Gly, Ile, Leu, Thr, Val or Met
  MOD_RES (2)..(2): Xaa = Asp or Glu
XXGR

SEQ ID NO: 171 - RNA, 22 nt, Homo sapiens
cuguacagccuccuagcuuucc

SEQ ID NO: 172 - RNA, 21 nt, Homo sapiens
cuauacaaucuacugucuuuc

SEQ ID NO: 173 - RNA, 22 nt, Homo sapiens
ugagguaguagguuguauaguu

SEQ ID NO: 174 - RNA, 22 nt, Homo sapiens
cuauacaaccuacugccuuccc

SEQ ID NO: 175 - RNA, 22 nt, Homo sapiens
ugagguaguagguugugugguu

SEQ ID NO: 176 - RNA, 22 nt, Homo sapiens
ugagguaguagguuguaugguu

SEQ ID NO: 177 - RNA, 22 nt, Homo sapiens
cuauacgaccugcugccuuucu

SEQ ID NO: 178 - RNA, 22 nt, Homo sapiens
agagguaguagguugcauaguu

SEQ ID NO: 179 - RNA, 22 nt, Homo sapiens
cuauacggccuccuagcuuucc

SEQ ID NO: 180 - RNA, 22 nt, Homo sapiens
ugagguaggagguuguauaguu

SEQ ID NO: 181 - RNA, 22 nt, Homo sapiens
cuauacaaucuauugccuuccc

SEQ ID NO: 182 - RNA, 22 nt, Homo sapiens
cuauacagucuacugucuuucc

SEQ ID NO: 183 - RNA, 22 nt, Homo sapiens
ugagguaguagauuguauaguu

SEQ ID NO: 184 - RNA, 21 nt, Homo sapiens
cuguacaggccacugccuugc

SEQ ID NO: 185 - RNA, 22 nt, Homo sapiens
ugagguaguaguuuguacaguu

SEQ ID NO: 186 - RNA, 22 nt, Homo sapiens
cugcgcaagcuacugccuugcu

SEQ ID NO: 187 - RNA, 22 nt, Homo sapiens
ugagguaguaguuugugcuguu

SEQ ID NO: 188 - RNA, 22 nt, Homo sapiens
uggaauguaaagaaguauguau

SEQ ID NO: 189 - RNA, 22 nt, Homo sapiens
caagcuuguaucuauagguaug

SEQ ID NO: 190 - RNA, 22 nt, Homo sapiens
aacccguagauccgaacuugug

SEQ ID NO: 191 - RNA, 21 nt, Homo sapiens
uacaguacugugauaacugaa

SEQ ID NO: 192 - RNA, 22 nt, Homo sapiens
caguuaucacagugcugaugcu

SEQ ID NO: 193 - RNA, 23 nt, Homo sapiens
agcuucuuuacagugcugccuug

SEQ ID NO: 194 - RNA, 23 nt, Homo sapiens
agcagcauuguacagggcuauga

SEQ ID NO: 195 - RNA, 23 nt, Homo sapiens
ucauagcccuguacaaugcugcu

SEQ ID NO: 196 - RNA, 22 nt, Homo sapiens
acggauguuugagcaugugcua

SEQ ID NO: 197 - RNA, 23 nt, Homo sapiens
ucaaaugcucagacuccuguggu

SEQ ID NO: 198 - RNA, 22 nt, Homo sapiens
cugcaauguaagcacuucuuac

SEQ ID NO: 199 - RNA, 23 nt, Homo sapiens
aaaagugcuuacagugcagguag

SEQ ID NO: 200 - RNA, 22 nt, Homo sapiens
ccgcacuguggguacuugcugc

SEQ ID NO: 201 - RNA, 21 nt, Homo sapiens
uaaagugcugacagugcagau

SEQ ID NO: 202 - RNA, 23 nt, Homo sapiens
agcagcauuguacagggcuauca

SEQ ID NO: 203 - RNA, 22 nt, Homo sapiens
caaauucguaucuaggggaaua

SEQ ID NO: 204 - RNA, 23 nt, Homo sapiens
uacccuguagauccgaauuugug

SEQ ID NO: 205 - RNA, 22 nt, Homo sapiens
acagauucgauucuaggggaau

SEQ ID NO: 206 - RNA, 23 nt, Homo sapiens
uacccuguagaaccgaauuugug

SEQ ID NO: 207 - RNA, 21 nt, Homo sapiens
uugcucacuguucuucccuag

SEQ ID NO: 208 - RNA, 18 nt, Homo sapiens
cagggucagcugagcaug

SEQ ID NO: 209 - RNA, 21 nt, Homo sapiens
aagcauucuuucauugguugg

SEQ ID NO: 210 - RNA, 22 nt, Homo sapiens
uuuccggcucgcgugggugugu

SEQ ID NO: 211 - RNA, 21 nt, Homo sapiens
ccgucgccgccacccgagccg

SEQ ID NO: 212 - RNA, 23 nt, Homo sapiens
gagggucuugggagggaugugac

SEQ ID NO: 213 - RNA, 27 nt, Homo sapiens
cacuguaggugauggugagagugggca

SEQ ID NO: 214 - RNA, 23 nt, Homo sapiens
ccugcagcgacuugauggcuucc

SEQ ID NO: 215 - RNA, 22 nt, Homo sapiens
auauacagggggagacucuuau

SEQ ID NO: 216 - RNA, 22 nt, Homo sapiens
auauacagggggagacucucau

SEQ ID NO: 217 - RNA, 21 nt, Homo sapiens
agaggauacccuuuguauguu

SEQ ID NO: 218 - RNA, 23 nt, Homo sapiens
gggaugguagaccggugacgugc

SEQ ID NO: 219 - RNA, 21 nt, Homo sapiens
uaggacacauggucuacuucu

SEQ ID NO: 220 - RNA, 22 nt, Homo sapiens
cuccugagccauucugagccuc

SEQ ID NO: 221 - RNA, 21 nt, Homo sapiens
gugccagcugcagugggggag

SEQ ID NO: 222 - RNA, 21 nt, Homo sapiens
cccggagccaggaugcagcuc

SEQ ID NO: 223 - RNA, 21 nt, Homo sapiens
ucguggccuggucuccauuau

SEQ ID NO: 224 - RNA, 20 nt, Homo sapiens
ucugcaggguuugcuuugag

SEQ ID NO: 225 - RNA, 21 nt, Homo sapiens
uguucauguagauguuuaagc

SEQ ID NO: 226 - RNA, 18 nt, Homo sapiens
ucagcuggcccucauuuc

SEQ ID NO: 227 - RNA, 21 nt, Homo sapiens
uggcagggaggcugggagggg

SEQ ID NO: 228 - RNA, 20 nt, Homo sapiens
ucacuguucagacaggcgga

SEQ ID NO: 229 - RNA, 22 nt, Homo sapiens
aacgccauuaucacacuaaaua

SEQ ID NO: 230 - RNA, 21 nt, Homo sapiens
ccccaccuccucucuccucag

SEQ ID NO: 231 - RNA, 19 nt, Homo sapiens
gugaggacucgggaggugg

SEQ ID NO: 232 - RNA, 22 nt, Homo sapiens
ugagccccugugccgcccccag

SEQ ID NO: 233 - RNA, 22 nt, Homo sapiens
guggguacggcccagugggggg

SEQ ID NO: 234 - RNA, 22 nt, Homo sapiens
uggagugugacaaugguguuug

SEQ ID NO: 235 - RNA, 22 nt, Homo sapiens
ucaccagcccuguguucccuag

SEQ ID NO: 236 - RNA, 26 nt, Homo sapiens
gugagggcaugcaggccuggaugggg

SEQ ID NO: 237 - RNA, 20 nt, Homo sapiens
cgugccacccuuuuccccag

SEQ ID NO: 238 - RNA, 17 nt, Homo sapiens
guggggccaggcggugg

SEQ ID NO: 239 - RNA, 20 nt, Homo sapiens
ucacaccugccucgcccccc

SEQ ID NO: 240 - RNA, 21 nt, Homo sapiens
gugggcgggggcaggugugug

SEQ ID NO: 241 - RNA, 23 nt, Homo sapiens
cucucaccacugcccucccacag

SEQ ID NO: 242 - RNA, 24 nt, Homo sapiens
guggguaggguuugggggagagcg

SEQ ID NO: 243 - RNA, 20 nt, Homo sapiens
gugucugggcggacagcugc

SEQ ID NO: 244 - RNA, 22 nt, Homo sapiens
agugggaggccagggcacggca

SEQ ID NO: 245 - RNA, 20 nt, Homo sapiens
ugagcccuguccucccgcag

SEQ ID NO: 246 - RNA, 22 nt, Homo sapiens
ucggccugaccacccaccccac

SEQ ID NO: 247 - RNA, 21 nt, Homo sapiens
ggggggggggggggggggccg

SEQ ID NO: 248 - RNA, 22 nt, Homo sapiens
ccucuuccccuugucucuccag

SEQ ID NO: 249 - RNA, 22 nt, Homo sapiens
ugagugacaggggaaaugggga

SEQ ID NO: 250 - RNA, 21 nt, Homo sapiens
uccuucugcuccgucccccag

SEQ ID NO: 251 - RNA, 21 nt, Homo sapiens
cgggggcggggccgaagcgcg

SEQ ID NO: 252 - RNA, 20 nt, Homo sapiens
cuuccucgucugucugcccc

SEQ ID NO: 253 - RNA, 23 nt, Homo sapiens
gugagugggagccccagugugug

SEQ ID NO: 254 - RNA, 22 nt, Homo sapiens
aacuggaucaauuauaggagug

SEQ ID NO: 255 - RNA, 20 nt, Homo sapiens
uaaggcacgcggugaaugcc

SEQ ID NO: 256 - RNA, 26 nt, Homo sapiens
aaguaguugguuuguaugagaugguu

SEQ ID NO: 257 - RNA, 21 nt, Homo sapiens
aagugaucuaaaggccuacau

SEQ ID NO: 258 - RNA, 22 nt, Homo sapiens
ucagaugaucuaaaggccuaua

SEQ ID NO: 259 - RNA, 21 nt, Homo sapiens
uaggccuuuagaucacuuaaa

SEQ ID NO: 260 - RNA, 22 nt, Homo sapiens
cguguucacagcggaccuugau

SEQ ID NO: 261 - RNA, 19 nt, Homo sapiens
aauggauuuuuggagcagg

SEQ ID NO: 262 - RNA, 24 nt, Homo sapiens
ccccgggaacgucgagacuggagc

SEQ ID NO: 263 - RNA, 22 nt, Homo sapiens
acccgucccguucguccccgga

SEQ ID NO: 264 - RNA, 27 nt, Homo sapiens
accuucuuguauaagcacugugcuaaa

SEQ ID NO: 265 - RNA, 22 nt, Homo sapiens
acgcccuucccccccuucuuca

SEQ ID NO: 266 - RNA, 21 nt, Homo sapiens
acggugcuggauguggccuuu

SEQ ID NO: 267 - RNA, 21 nt, Homo sapiens
acucuagcugccaaaggcgcu

SEQ ID NO: 268 - RNA, 22 nt, Homo sapiens
agaaggaaauugaauucauuua

SEQ ID NO: 269 - RNA, 21 nt, Homo sapiens
agagaagaagaucagccugca

SEQ ID NO: 270 - RNA, 24 nt, Homo sapiens
agccuggaagcuggagccugcagu

SEQ ID NO: 271 - RNA, 23 nt, Homo sapiens
aggaugagcaaagaaaguagauu

SEQ ID NO: 272 - RNA, 22 nt, Homo sapiens
aaccacuuucuuugcucaucca

SEQ ID NO: 273 - RNA, 22 nt, Homo sapiens
cggaugagcaaagaaagugguu

SEQ ID NO: 274 - RNA, 22 nt, Homo sapiens
aggcauugacuucucacuagcu

SEQ ID NO: 275 - RNA, 21 nt, Homo sapiens
agugaaugauggguucugacc

SEQ ID NO: 276 - RNA, 21 nt, Homo sapiens
aguuaggauuaggucguggaa

SEQ ID NO: 277 - RNA, 22 nt, Homo sapiens
acaggugagguucuugggagcc

SEQ ID NO: 278 - RNA, 24 nt, Homo sapiens
ucccugagacccuuuaaccuguga

SEQ ID NO: 279 - RNA, 22 nt, Homo sapiens
acggguuaggcucuugggagcu

SEQ ID NO: 280 - RNA, 22 nt, Homo sapiens
ucacaagucaggcucuugggac

SEQ ID NO: 281 - RNA, 22 nt, Homo sapiens
ucccugagacccuaacuuguga

SEQ ID NO: 282 - RNA, 18 nt, Homo sapiens
aucccaccucugccacca

SEQ ID NO: 283 - RNA, 19 nt, Homo sapiens
aucccaccacugccaccau

SEQ ID NO: 284 - RNA, 19 nt, Homo sapiens
auggauaaggcuuuggcuu

SEQ ID NO: 285 - RNA, 22 nt, Homo sapiens
augggugaauuuguagaaggau

SEQ ID NO: 286 - RNA, 22 nt, Homo sapiens
augguacccuggcauacugagu

SEQ ID NO: 287 - RNA, 22 nt, Homo sapiens
ucguaccgugaguaauaaugcg

SEQ ID NO: 288 - RNA, 23 nt, Homo sapiens
caagucuuauuugagcaccuguu

SEQ ID NO: 289 - RNA, 22 nt, Homo sapiens
caggauguggucaaguguuguu

SEQ ID NO: 290 - RNA, 21 nt, Homo sapiens
cauuauuacuuuugguacgcg

SEQ ID NO: 291 - RNA, 23 nt, Homo sapiens
ccucagggcuguagaacagggcu

SEQ ID NO: 292 - RNA, 21 nt, Homo sapiens
ccuguugaaguguaaucccca

SEQ ID NO: 293 - RNA, 18 nt, Homo sapiens
cgggcguggugguggggg

SEQ ID NO: 294 - RNA, 20 nt, Homo sapiens
cgggcgugguggugggggug

SEQ ID NO: 295 - RNA, 22 nt, Homo sapiens
cuggacugagccgugcuacugg

SEQ ID NO: 296 - RNA, 22 nt, Homo sapiens
cuggacugagccaugcuacugg

SEQ ID NO: 297 - RNA, 23 nt, Homo sapiens
cuggagauauggaagagcugugu

SEQ ID NO: 298 - RNA, 22 nt, Homo sapiens
agugccugcuaugugccaggca

SEQ ID NO: 299 - RNA, 22 nt, Homo sapiens
cuuggcaccuagcaagcacuca

SEQ ID NO: 300 - RNA, 26 nt, Homo sapiens
gaugaugauggcagcaaauucugaaa

SEQ ID NO: 301 - RNA, 25 nt, Homo sapiens
gggcgacaaagcaagacucuuucuu

SEQ ID NO: 302 - RNA, 22 nt, Homo sapiens
ggcgacaaaacgagacccuguc

SEQ ID NO: 303 - RNA, 25 nt, Homo sapiens
gaacccaugagguugaggcugcagu

SEQ ID NO: 304 - RNA, 22 nt, Homo sapiens
uugcuugaacccaggaagugga

SEQ ID NO: 305 - RNA, 19 nt, Homo sapiens
ggagauggagguugcagug

SEQ ID NO: 306 - RNA, 21 nt, Homo sapiens
accacugcacuccagccugag

SEQ ID NO: 307 - RNA, 22 nt, Homo sapiens
ggugguugaggcugcaguaagu

SEQ ID NO: 308 - RNA, 22 nt, Homo sapiens
ucggauccgucugagcuuggcu

SEQ ID NO: 309 - RNA, 17 nt, Homo sapiens
gugggggagaggcuguc

SEQ ID NO: 310 - RNA, 22 nt, Homo sapiens
cugaagcucagagggcucugau

SEQ ID NO: 311 - RNA, 20 nt, Homo sapiens
uaaagagcccuguggagaca

SEQ ID NO: 312 - RNA, 22 nt, Homo sapiens
uacguagauauauauguauuuu

SEQ ID NO: 313 - RNA, 24 nt, Homo sapiens
aaauauauauauauauguacguau

SEQ ID NO: 314 - RNA, 22 nt, Homo sapiens
uaguacugugcauaucaucuau

SEQ ID NO: 315 - RNA, 17 nt, Homo sapiens
ucauauugcuucuuucu

SEQ ID NO: 316 - RNA, 21 nt, Homo sapiens
ucacagugaaccggucucuuu

SEQ ID NO: 317 - RNA, 17 nt, Homo sapiens
ucgccuccuccucuccc

SEQ ID NO: 318 - RNA, 20 nt, Homo sapiens
ucguuugccuuuuucugcuu

SEQ ID NO: 319 - RNA, 22 nt, Homo sapiens
ucuacaaaggaaagcgcuuucu

SEQ ID NO: 320 - RNA, 22 nt, Homo sapiens
ucuauacagacccuggcuuuuc

SEQ ID NO: 321 - RNA, 22 nt, Homo sapiens
ucugggcaacaaagugagaccu

SEQ ID NO: 322 - RNA, 21 nt, Homo sapiens
gaucucacuuuguugcccagg

SEQ ID NO: 323 - RNA, 21 nt, Homo sapiens
ugcaggaccaagaugagcccu

SEQ ID NO: 324 - RNA, 22 nt, Homo sapiens
ugcuggaucagugguucgaguc

SEQ ID NO: 325 - RNA, 21 nt, Homo sapiens
uggacugcccugaucuggaga

SEQ ID NO: 326 - RNA, 23 nt, Homo sapiens
uggaguccaggaaucugcauuuu

SEQ ID NO: 327 - RNA, 19 nt, Homo sapiens
uggauuuuuggaucaggga

SEQ ID NO: 328 - RNA, 24 nt, Homo sapiens
uggcccugacugaagaccagcagu

SEQ ID NO: 329 - RNA, 22 nt, Homo sapiens
aagcccuuaccccaaaaaguau

SEQ ID NO: 330 - RNA, 20 nt, Homo sapiens
ucgcgccccggcucccguuc

SEQ ID NO: 331 - RNA, 22 nt, Homo sapiens
aagcccuuaccccaaaaagcau

SEQ ID NO: 332 - RNA, 25 nt, Homo sapiens
ugggaacggguuccggcagacgcug

SEQ ID NO: 333 - RNA, 22 nt, Homo sapiens
uggguggucuggagauuugugc

SEQ ID NO: 334 - RNA, 22 nt, Homo sapiens
ugugagguuggcauuguugucu

SEQ ID NO: 335 - RNA, 21 nt, Homo sapiens
uuaggccgcagaucuggguga

SEQ ID NO: 336 - RNA, 22 nt, Homo sapiens
aauaggccacggaucugggcaa

SEQ ID NO: 337 - RNA, 21 nt, Homo sapiens
cacccagaucugcggccuaau

SEQ ID NO: 338 - RNA, 21 nt, Homo sapiens
cuuuuugcggucugggcuugc

SEQ ID NO: 339 - RNA, 22 nt, Homo sapiens
uuagggcccuggcuccaucucc

SEQ ID NO: 340 - RNA, 17 nt, Homo sapiens
uucaaguaauucaggug

SEQ ID NO: 341 - RNA, 22 nt, Homo sapiens
uucauucggcuguccagaugua

SEQ ID NO: 342 - RNA, 22 nt, Homo sapiens
uucuggaauucugugugaggga

SEQ ID NO: 343 - RNA, 24 nt, Homo sapiens
uugcagcugccugggagugacuuc

SEQ ID NO: 344 - RNA, 21 nt, Homo sapiens
uugggacauacuuaugcuaaa

SEQ ID NO: 345 - RNA, 22 nt, Homo sapiens
uuuagagacggggucuugcucu

SEQ ID NO: 346 - RNA, 22 nt, Homo sapiens
ucucacuguagccucgaacccc

SEQ ID NO: 347 - RNA, 22 nt, Homo sapiens
uuugaggcuacagugagaugug

SEQ ID NO: 348 - RNA, 22 nt, Homo sapiens
uuuucaacucuaaugggagaga

SEQ ID NO: 349 - RNA, 18 nt, Homo sapiens
acguuggcucugguggug

SEQ ID NO: 350 - RNA, 22 nt, Homo sapiens
ccaccuccccugcaaacgucca

SEQ ID NO: 351 - RNA, 22 nt, Homo sapiens
acucggcguggcgucggucgug

SEQ ID NO: 352 - RNA, 21 nt, Homo sapiens
ucgaccggaccucgaccggcu

SEQ ID NO: 353 - RNA, 22 nt, Homo sapiens
cagugcaauguuaaaagggcau

SEQ ID NO: 354 - RNA, 22 nt, Homo sapiens
uucacauugugcuacugucugc

SEQ ID NO: 355 - RNA, 22 nt, Homo sapiens
cagugcaaugaugaaagggcau

SEQ ID NO: 356 - RNA, 21 nt, Homo sapiens
acucuuucccuguugcacuac

SEQ ID NO: 357 - RNA, 18 nt, Homo sapiens
cagggaggugaaugugau

SEQ ID NO: 358 - RNA, 19 nt, Homo sapiens
gaugaugcugcugaugcug

SEQ ID NO: 359 - RNA, 22 nt, Homo sapiens
ucaaaacugaggggcauuuucu

SEQ ID NO: 360 - RNA, 22 nt, Homo sapiens
uaacagucuacagccauggucg

SEQ ID NO: 361 - RNA, 24 nt, Homo sapiens
ccagacagaauucuaugcacuuuc

SEQ ID NO: 362 - RNA, 22 nt, Homo sapiens
accguggcuuucgauuguuacu

SEQ ID NO: 363 - RNA, 22 nt, Homo sapiens
uuugguccccuucaaccagcug

SEQ ID NO: 364 - RNA, 22 nt, Homo sapiens
uuugguccccuucaaccagcua

SEQ ID NO: 365 - RNA, 22 nt, Homo sapiens
ugugacugguugaccagagggg

SEQ ID NO: 366 - RNA, 22 nt, Homo sapiens
cuccuggggcccgcacucucgc

SEQ ID NO: 367 - RNA, 22 nt, Homo sapiens
uauagggauuggagccguggcg

SEQ ID NO: 368 - RNA, 23 nt, Homo sapiens
uauggcuuuuuauuccuauguga

SEQ ID NO: 369 - RNA, 22 nt, Homo sapiens
auguagggcuaaaagccauggg

SEQ ID NO: 370 - RNA, 23 nt, Homo sapiens
uauggcuuuucauuccuauguga

SEQ ID NO: 371 - RNA, 22 nt, Homo sapiens
caucaucgucucaaaugagucu

SEQ ID NO: 372 - RNA, 23 nt, Homo sapiens
acuccauuuguuuugaugaugga

SEQ ID NO: 373 - RNA, 23 nt, Homo sapiens
uuauugcuuaagaauacgcguag

SEQ ID NO: 374 - RNA, 22 nt, Homo sapiens
gcuacuucacaacaccagggcc

SEQ ID NO: 375 - RNA, 22 nt, Homo sapiens
gcuauuucacgacaccaggguu

SEQ ID NO: 376 - RNA, 23 nt, Homo sapiens
agcugguguugugaaucaggccg

SEQ ID NO: 377 - RNA, 23 nt, Homo sapiens
uggagacgcggcccuguuggagu

SEQ ID NO: 378 - RNA, 23 nt, Homo sapiens
ucuacagugcacgugucuccagu

SEQ ID NO: 379 - RNA, 21 nt, Homo sapiens
uaccacaggguagaaccacgg

SEQ ID NO: 380 - RNA, 22 nt, Homo sapiens
cagugguuuuacccuaugguag

SEQ ID NO: 381 - RNA, 22 nt, Homo sapiens
uaacacugucugguaaagaugg

SEQ ID NO: 382 - RNA, 22 nt, Homo sapiens
caucuuccaguacaguguugga

SEQ ID NO: 383 - RNA, 23 nt, Homo sapiens
uguaguguuuccuacuuuaugga

SEQ ID NO: 384 - RNA, 21 nt, Homo sapiens
cauaaaguagaaagcacuacu

SEQ ID NO: 385 - RNA, 21 nt, Homo sapiens
ugagaugaagcacuguagcuc

SEQ ID NO: 386 - RNA, 22 nt, Homo sapiens
ggugcagugcugcaucucuggu

SEQ ID NO: 387 - RNA, 20 nt, Homo sapiens
uacaguauagaugauguacu

SEQ ID NO: 388 - RNA, 22 nt, Homo sapiens
ggauaucaucauauacuguaag

SEQ ID NO: 389 - RNA, 22 nt, Homo sapiens
ggauuccuggaaauacuguucu

SEQ ID NO: 390 - RNA, 23 nt, Homo sapiens
guccaguuuucccaggaaucccu

SEQ ID NO: 391 - RNA, 21 nt, Homo sapiens
cuccguuugccuguuucgcug

SEQ ID NO: 392 - RNA, 22 nt, Homo sapiens
cucggcgcggggcgcgggcucc

SEQ ID NO: 393 - RNA, 22 nt, Homo sapiens
ccucugaaauucaguucuucag

SEQ ID NO: 394 - RNA, 22 nt, Homo sapiens
ugagaacugaauuccauggguu

SEQ ID NO: 395 - RNA, 22 nt, Homo sapiens
ugcccuguggacucaguucugg

SEQ ID NO: 396 - RNA, 22 nt, Homo sapiens
ugagaacugaauuccauaggcu

SEQ ID NO: 397 - RNA, 21 nt, Homo sapiens
gcccuccgcccgugcaccccg

SEQ ID NO: 398 - RNA, 22 nt, Homo sapiens
gcccgcguguggagccaggugu

SEQ ID NO: 399 - RNA, 20 nt, Homo sapiens
guguguggaaaugcuucugc

SEQ ID NO: 400 - RNA, 22 nt, Homo sapiens
gugugcggaaaugcuucugcua

SEQ ID NO: 401 - RNA, 22 nt, Homo sapiens
ucagugcacuacagaacuuugu

SEQ ID NO: 402 - RNA, 22 nt, Homo sapiens
aaaguucugagacacuccgacu

SEQ ID NO: 403 - RNA, 22 nt, Homo sapiens
ucagugcaucacagaacuuugu

SEQ ID NO: 404 - RNA, 22 nt, Homo sapiens
aaguucuguuauacacucaggc

SEQ ID NO: 405 - RNA, 21 nt, Homo sapiens
agggagggacgggggcugugc

SEQ ID NO: 406 - RNA, 23 nt, Homo sapiens
ucuggcuccgugucuucacuccc

SEQ ID NO: 407 - RNA, 22 nt, Homo sapiens
cugguacaggccugggggacag

SEQ ID NO: 408 - RNA, 22 nt, Homo sapiens
ucucccaacccuuguaccagug

SEQ ID NO: 409 - RNA, 21 nt, Homo sapiens
cuagacugaagcuccuugagg

SEQ ID NO: 410 - RNA, 21 nt, Homo sapiens
ucgaggagcucacagucuagu

SEQ ID NO: 411 - RNA, 18 nt, Homo sapiens
ucgaggagcucacagucu

SEQ ID NO: 412 - RNA, 21 nt, Homo sapiens
ucagugcaugacagaacuugg

SEQ ID NO: 413 - RNA, 22 nt, Homo sapiens
uugcauagucacaaaagugauc

SEQ ID NO: 414 - RNA, 22 nt, Homo sapiens
aaaaccgucuaguuacaguugu

SEQ ID NO: 415 - RNA, 23 nt, Homo sapiens
cggcccgggcugcugcuguuccu

SEQ ID NO: 416 - RNA, 21 nt, Homo sapiens
uccugcgcgucccagaugccc

SEQ ID NO: 417 - RNA, 22 nt, Homo sapiens
aaucauacacgguugaccuauu

SEQ ID NO: 418 - RNA, 22 nt, Homo sapiens
uagguuauccguguugccuucg

SEQ ID NO: 419 - RNA, 22 nt, Homo sapiens
cuccuacauauuagcauuaaca

SEQ ID NO: 420 - RNA, 23 nt, Homo sapiens
uuaaugcuaaucgugauaggggu

SEQ ID NO: 421 - RNA, 20 nt, Homo sapiens
uugggcugggcuggguuggg

SEQ ID NO: 422 - RNA, 22 nt, Homo sapiens
caggccauauugugcugccuca

SEQ ID NO: 423 - RNA, 22 nt, Homo sapiens
uagcagcacauaaugguuugug

SEQ ID NO: 424 - RNA, 22 nt, Homo sapiens
cgaaucauuauuugcugcucua

SEQ ID NO: 425 - RNA, 22 nt, Homo sapiens
uagcagcacaucaugguuuaca

SEQ ID NO: 426 - RNA, 22 nt, Homo sapiens
ccaguauuaacugugcugcuga

SEQ ID NO: 427 - RNA, 22 nt, Homo sapiens
ccaauauuacugugcugcuuua

SEQ ID NO: 428 - RNA, 22 nt, Homo sapiens
uagcagcacguaaauauuggcg

SEQ ID NO: 429 - RNA, 22 nt, Homo sapiens
acugcagugaaggcacuuguag

SEQ ID NO: 430 - RNA, 23 nt, Homo sapiens
caaagugcuuacagugcagguag

SEQ ID NO: 431 - RNA, 22 nt, Homo sapiens
accacugaccguugacuguacc

SEQ ID NO: 432 - RNA, 22 nt, Homo sapiens
accaucgaccguugauuguacc

SEQ ID NO: 433 - RNA, 23 nt, Homo sapiens
aacauucaacgcugucggugagu

SEQ ID NO: 434 - RNA, 21 nt, Homo sapiens
cucacugaacaaugaaugcaa

SEQ ID NO: 435 - RNA, 23 nt, Homo sapiens
aacauucauugcugucggugggu

SEQ ID NO: 436 - RNA, 22 nt, Homo sapiens
aaccaucgaccguugaguggac

SEQ ID NO: 437 - RNA, 22 nt, Homo sapiens
aacauucaaccugucggugagu

SEQ ID NO: 438 - RNA, 23 nt, Homo sapiens
aacauucauuguugucggugggu

SEQ ID NO: 439 - RNA, 21 nt, Homo sapiens
ugguucuagacuugccaacua

SEQ ID NO: 440 - RNA, 18 nt, Homo sapiens
uccagugcccuccucucc

SEQ ID NO: 441 - RNA, 24 nt, Homo sapiens
uuuggcaaugguagaacucacacu

SEQ ID NO: 442 - RNA, 18 nt, Homo sapiens
ugaggcaguagauugaau

SEQ ID NO: 443 - RNA, 22 nt, Homo sapiens
gugaauuaccgaagggccauaa

SEQ ID NO: 444 - RNA, 22 nt, Homo sapiens
uauggcacugguagaauucacu

SEQ ID NO: 445 - RNA, 22 nt, Homo sapiens
uggacggagaacugauaagggu

SEQ ID NO: 446 - RNA, 22 nt, Homo sapiens
aggggcuggcuuuccucugguc

SEQ ID NO: 447 - RNA, 22 nt, Homo sapiens
uggagagaaaggcaguuccuga

SEQ ID NO: 448 - RNA, 22 nt, Homo sapiens
gcccaaaggugaauuuuuuggg

SEQ ID NO: 449 - RNA, 22 nt, Homo sapiens
caaagaauucuccuuuugggcu

SEQ ID NO: 450 - RNA, 22 nt, Homo sapiens
ucgugucuuguguugcagccgg

SEQ ID NO: 451 - RNA, 22 nt, Homo sapiens
ggcuacaacacaggacccgggc

SEQ ID NO: 452 - RNA, 21 nt, Homo sapiens
cucccacaugcaggguuugca

SEQ ID NO: 453 - RNA, 21 nt, Homo sapiens
caucccuugcaugguggaggg

SEQ ID NO: 454 - RNA, 23 nt, Homo sapiens
acugcccuaagugcuccuucugg

SEQ ID NO: 455 - RNA, 23 nt, Homo sapiens
uaaggugcaucuagugcagauag

SEQ ID NO: 456 - RNA, 22 nt, Homo sapiens
ugcccuaaaugccccuucuggc

SEQ ID NO: 457 - RNA, 23 nt, Homo sapiens
uaaggugcaucuagugcaguuag

SEQ ID NO: 458 - RNA, 21 nt, Homo sapiens
cggcggggacggcgauugguc

SEQ ID NO: 459 - RNA, 22 nt, Homo sapiens
cgcaggggccgggugcucaccg

SEQ ID NO: 460 - RNA, 21 nt, Homo sapiens
ugagugccggugccugcccug

SEQ ID NO: 461 - RNA, 22 nt, Homo sapiens
ugauauguuugauauauuaggu

SEQ ID NO: 462 - RNA, 21 nt, Homo sapiens
ugauauguuugauauuggguu

SEQ ID NO: 463 - RNA, 21 nt, Homo sapiens
ccaguccugugccugccgccu

SEQ ID NO: 464 - RNA, 20 nt, Homo sapiens
caccaggcauuguggucucc

SEQ ID NO: 465 - RNA, 23 nt, Homo sapiens
ugaguaccgccaugucuguuggg

SEQ ID NO: 466 - RNA, 22 nt, Homo sapiens
uacccagagcaugcagugugaa

SEQ ID NO: 467 - RNA, 22 nt, Homo sapiens
ucugcccccuccgcugcugcca

SEQ ID NO: 468 - RNA, 22 nt, Homo sapiens
gcugcgcuuggauuucgucccc

SEQ ID NO: 469 - RNA, 22 nt, Homo sapiens
ggaggggucccgcacugggagg

SEQ ID NO: 470 - RNA, 22 nt, Homo sapiens
cccugugcccggcccacuucug

SEQ ID NO: 471 - RNA, 20 nt, Homo sapiens
ccccagggcgacgcggcggg

SEQ ID NO: 472 - RNA, 22 nt, Homo sapiens
accuugccuugcugcccgggcc

SEQ ID NO: 473 - RNA, 23 nt, Homo sapiens
caacggaaucccaaaagcagcug

SEQ ID NO: 474 - RNA, 22 nt, Homo sapiens
cugccaauuccauaggucacag

SEQ ID NO: 475 - RNA, 21 nt, Homo sapiens
cugaccuaugaauugacagcc

SEQ ID NO: 476 - RNA, 22 nt, Homo sapiens
aacuggccuacaaagucccagu

SEQ ID NO: 477 - RNA, 22 nt, Homo sapiens
ugggucuuugcgggcgagauga

SEQ ID NO: 478 - RNA, 22 nt, Homo sapiens
aacuggcccucaaagucccgcu

SEQ ID NO: 479 - RNA, 22 nt, Homo sapiens
cgggguuuugagggcgagauga

SEQ ID NO: 480 - RNA, 22 nt, Homo sapiens
ccaguggggcugcuguuaucug

SEQ ID NO: 481 - RNA, 22 nt, Homo sapiens
uguaacagcaacuccaugugga

SEQ ID NO: 482 - RNA, 22 nt, Homo sapiens
ccaauauuggcugugcugcucc

SEQ ID NO: 483 - RNA, 21 nt, Homo sapiens
uagcagcacagaaauauuggc

SEQ ID NO: 484 - RNA, 22 nt, Homo sapiens
cggcaacaagaaacugccugag

SEQ ID NO: 485 - RNA, 22 nt, Homo sapiens
uagguaguuucauguuguuggg

SEQ ID NO: 486 - RNA, 22 nt, Homo sapiens
ucgacagcacgacacugccuuc

SEQ ID NO: 487 - RNA, 22 nt, Homo sapiens
uagguaguuuccuguuguuggg

SEQ ID NO: 488 - RNA, 22 nt, Homo sapiens
ucaggccaggcacaguggcuca

SEQ ID NO: 489 - RNA, 19 nt, Homo sapiens
accgugcaaagguagcaua

SEQ ID NO: 490 - RNA, 22 nt, Homo sapiens
uucaccaccuucuccacccagc

SEQ ID NO: 491 - RNA, 23 nt, Homo sapiens
cggguagagagggcagugggagg

SEQ ID NO: 492 - RNA, 20 nt, Homo sapiens
ccuccugcccuccuugcugu

SEQ ID NO: 493 - RNA, 22 nt, Homo sapiens
gguccagaggggagauagguuc

SEQ ID NO: 494 - RNA, 22 nt, Homo sapiens
acaguagucugcacauugguua

SEQ ID NO: 495 - RNA, 23 nt, Homo sapiens
cccaguguucagacuaccuguuc

SEQ ID NO: 496 - RNA, 22 nt, Homo sapiens
acaguagucugcacauugguua

SEQ ID NO: 497 - RNA, 23 nt, Homo sapiens
cccaguguuuagacuaucuguuc

SEQ ID NO: 498 - RNA, 23 nt, Homo sapiens
ugugcaaaucuaugcaaaacuga

SEQ ID NO: 499 - RNA, 22 nt, Homo sapiens
aguuuugcauaguugcacuaca

SEQ ID NO: 500 - RNA, 23 nt, Homo sapiens
aguuuugcagguuugcauccagc

SEQ ID NO: 501 - RNA, 22 nt, Homo sapiens
aguuuugcagguuugcauuuca

SEQ ID NO: 502 - RNA, 23 nt, Homo sapiens
ugugcaaauccaugcaaaacuga

SEQ ID NO: 503 - RNA, 22 nt, Homo sapiens
uaacacugucugguaacgaugu

SEQ ID NO: 504 - RNA, 22 nt, Homo sapiens
caucuuaccggacagugcugga

SEQ ID NO: 505 - RNA, 22 nt, Homo sapiens
uaauacugccugguaaugauga

SEQ ID NO: 506 - RNA, 22 nt, Homo sapiens
caucuuacugggcagcauugga

SEQ ID NO: 507 - RNA, 23 nt, Homo sapiens
uaauacugccggguaaugaugga

SEQ ID NO: 508 - RNA, 22 nt, Homo sapiens
cgucuuacccagcaguguuugg

SEQ ID NO: 509 - RNA, 20 nt, Homo sapiens
agagguauagggcaugggaa

SEQ ID NO: 510 - RNA, 22 nt, Homo sapiens
uuccuaugcauauacuucuuug

SEQ ID NO: 511 - RNA, 22 nt, Homo sapiens
gugaaauguuuaggaccacuag

SEQ ID NO: 512 - RNA, 23 nt, Homo sapiens
uugaacuguuaagaaccacugga

SEQ ID NO: 513 - RNA, 22 nt, Homo sapiens
uagugguccuaaacauuucaca

SEQ ID NO: 514 - RNA, 21 nt, Homo sapiens
gcugggaaggcaaagggacgu

SEQ ID NO: 515 - RNA, 22 nt, Homo sapiens
uucccuuugucauccuaugccu

SEQ ID NO: 516 - RNA, 20 nt, Homo sapiens
uguuuugauaacaguaaugu

SEQ ID NO: 517 - RNA, 23 nt, Homo sapiens
guguuaauuaaaccucuauuuac

SEQ ID NO: 518 - RNA, 21 nt, Homo sapiens
gauuucaguggagugaaguuc

SEQ ID NO: 519 - RNA, 23 nt, Homo sapiens
cuguaauauaaauuuaauuuauu

SEQ ID NO: 520 - RNA, 22 nt, Homo sapiens
uccuucauuccaccggagucug

SEQ ID NO: 521 - RNA, 22 nt, Homo sapiens
uggaauguaaggaagugugugg

SEQ ID NO: 522 - RNA, 22 nt, Homo sapiens
auaagacgagcaaaaagcuugu

SEQ ID NO: 523 - RNA, 22 nt, Homo sapiens
auaagacgaacaaaagguuugu

SEQ ID NO: 524 - RNA, 22 nt, Homo sapiens
acugcauuaugagcacuuaaag

SEQ ID NO: 525 - RNA, 23 nt, Homo sapiens
uaaagugcuuauagugcagguag

SEQ ID NO: 526 - RNA, 22 nt, Homo sapiens
acuguaguaugggcacuuccag

SEQ ID NO: 527 - RNA, 23 nt, Homo sapiens
caaagugcucauagugcagguag

SEQ ID NO: 528 - RNA, 22 nt, Homo sapiens
cugugcgugugacagcggcuga

SEQ ID NO: 529 - RNA, 22 nt, Homo sapiens
uuggggaaacggccgcugagug

SEQ ID NO: 530 - RNA, 21 nt, Homo sapiens
auuugugcuuggcucugucac

SEQ ID NO: 531 - RNA, 21 nt, Homo sapiens
gcagggacagcaaaggggugc

SEQ ID NO: 532 - RNA, 21 nt, Homo sapiens
cgagccucaagcaagggacuu

SEQ ID NO: 533 - RNA, 22 nt, Homo sapiens
uagucccuuccuugaagcgguc

SEQ ID NO: 534 - RNA, 22 nt, Homo sapiens
caucagaauucauggaggcuag

SEQ ID NO: 535 - RNA, 22 nt, Homo sapiens
agcuuccaugacuccugaugga

SEQ ID NO: 536 - RNA, 22 nt, Homo sapiens
uucccuuugucauccuucgccu

SEQ ID NO: 537 - RNA, 21 nt, Homo sapiens
ccucccaugccaagaacuccc

SEQ ID NO: 538 - RNA, 21 nt, Homo sapiens
gguucuuagcauaggaggucu

SEQ ID NO: 539 - RNA, 21 nt, Homo sapiens
uguucucuuugccaaggacag

SEQ ID NO: 540 - RNA, 21 nt, Homo sapiens
uaacagucuccagucacggcc

SEQ ID NO: 541 - RNA, 23 nt, Homo sapiens
accuuggcucuagacugcuuacu

SEQ ID NO: 542 - RNA, 21 nt, Homo sapiens
caacaccagucgaugggcugu

SEQ ID NO: 543 - RNA, 22 nt, Homo sapiens
acagcaggcacagacaggcagu

SEQ ID NO: 544 - RNA, 22 nt, Homo sapiens
ugccugucuacacuugcugugc

SEQ ID NO: 545 - RNA, 21 nt, Homo sapiens
augaccuaugaauugacagac

SEQ ID NO: 546 - RNA, 22 nt, Homo sapiens
uagcuuaucagacugauguuga

SEQ ID NO: 547 - RNA, 22 nt, Homo sapiens
ucacaguggucucugggauuau

SEQ ID NO: 548 - RNA, 22 nt, Homo sapiens
uaaucucagcuggcaacuguga

SEQ ID NO: 549 - RNA, 22 nt, Homo sapiens
aaaucucugcaggcaaauguga

SEQ ID NO: 550 - RNA, 23 nt, Homo sapiens
uacugcaucaggaacugauugga

SEQ ID NO: 551 - RNA, 22 nt, Homo sapiens
augguuccgucaagcaccaugg

SEQ ID NO: 552 - RNA, 22 nt, Homo sapiens
caugguucugucaagcaccgcg

SEQ ID NO: 553 - RNA, 21 nt, Homo sapiens
uugugcuugaucuaaccaugu

SEQ ID NO: 554 - RNA, 22 nt, Homo sapiens
agaguugagucuggacgucccg

SEQ ID NO: 555 - RNA, 22 nt, Homo sapiens
agaauuguggcuggacaucugu

SEQ ID NO: 556 - RNA, 21 nt, Homo sapiens
ugauuguccaaacgcaauucu

SEQ ID NO: 557 - RNA, 23 nt, Homo sapiens
agcuacauugucugcuggguuuc

SEQ ID NO: 558 - RNA, 22 nt, Homo sapiens
accuggcauacaauguagauuu

SEQ ID NO: 559 - RNA, 21 nt, Homo sapiens
agcuacaucuggcuacugggu

SEQ ID NO: 560 - RNA, 22 nt, Homo sapiens
cucaguagccaguguagauccu

SEQ ID NO: 561 - RNA, 22 nt, Homo sapiens
ugucaguuugucaaauacccca

SEQ ID NO: 562 - RNA, 22 nt, Homo sapiens
cguguauuugacaagcugaguu

SEQ ID NO: 563 - RNA, 22 nt, Homo sapiens
aagcugccaguugaagaacugu

SEQ ID NO: 564 - RNA, 23 nt, Homo sapiens
aaaauggugcccuagugacuaca

SEQ ID NO: 565 - RNA, 21 nt, Homo sapiens
caagucacuagugguuccguu

SEQ ID NO: 566 - RNA, 22 nt, Homo sapiens
aguucuucaguggcaagcuuua

SEQ ID NO: 567 - RNA, 22 nt, Homo sapiens
ucugcaagugucagaggcgagg

SEQ ID NO: 568 - RNA, 21 nt, Homo sapiens
ugacagcgcccugccuggcuc

SEQ ID NO: 569 - RNA, 24 nt, Homo sapiens
agcgcgggcugagcgcugccaguc

SEQ ID NO: 570 - RNA, 22 nt, Homo sapiens
gagagcaguguguguugccugg

SEQ ID NO: 571 - RNA, 22 nt, Homo sapiens
auuguccuugcuguuuggagau

SEQ ID NO: 572 - RNA, 21 nt, Homo sapiens
auccccagauacaauggacaa

SEQ ID NO: 573 - RNA, 20 nt, Homo sapiens
uaggaugggggugagaggug

SEQ ID NO: 574 - RNA, 21 nt, Homo sapiens
aucacauugccagggauuucc

SEQ ID NO: 575 - RNA, 22 nt, Homo sapiens
gggguuccuggggaugggauuu

SEQ ID NO: 576 - RNA, 21 nt, Homo sapiens
aucacauugccagggauuacc

SEQ ID NO: 577 - RNA, 22 nt, Homo sapiens
uggguuccuggcaugcugauuu

SEQ ID NO: 578 - RNA, 22 nt, Homo sapiens
aucacauugccagugauuaccc

SEQ ID NO: 579 - RNA, 22 nt, Homo sapiens
ugccuacugagcugauaucagu

SEQ ID NO: 580 - RNA, 22 nt, Homo sapiens
ugccuacugagcugaaacacag

SEQ ID NO: 581 - RNA, 22 nt, Homo sapiens
uggcucaguucagcaggaacag

SEQ ID NO: 582 - RNA, 22 nt, Homo sapiens
agcagaggcagagaggcucagg

SEQ ID NO: 583 - RNA, 23 nt, Homo sapiens
ugaggcucuguuagccuuggcuc

SEQ ID NO: 584 - RNA, 22 nt, Homo sapiens
cauugcacuugucucggucuga

SEQ ID NO: 585 - RNA, 21 nt, Homo sapiens
aggcggagacuugggcaauug

SEQ ID NO: 586 - RNA, 22 nt, Homo sapiens
uaucauggaguugguaaagcac

SEQ ID NO: 587 - RNA, 22 nt, Homo sapiens
guuuuaccaccuccaggagacu

SEQ ID NO: 588 - RNA, 22 nt, Homo sapiens
cgccucuucagcgcugucuucc

SEQ ID NO: 589 - RNA, 23 nt, Homo sapiens
caggcagugacuguucagacguc

SEQ ID NO: 590 - RNA, 22 nt, Homo sapiens
ccuauucuugguuacuugcacg

SEQ ID NO: 591 - RNA, 22 nt, Homo sapiens
ccuauucuugauuacuuguuuc

SEQ ID NO: 592 - RNA, 22 nt, Homo sapiens
uucaaguaauccaggauaggcu

SEQ ID NO: 593 - RNA, 22 nt, Homo sapiens
ccuguucuccauuacuuggcuc

SEQ ID NO: 594 - RNA, 21 nt, Homo sapiens
uucaaguaauucaggauaggu

SEQ ID NO: 595 - RNA, 21 nt, Homo sapiens
uucacaguggcuaaguuccgc

SEQ ID NO: 596 - RNA, 22 nt, Homo sapiens
agggcuuagcugcuugugagca

SEQ ID NO: 597 - RNA, 21 nt, Homo sapiens
uucacaguggcuaaguucugc

SEQ ID NO: 598 - RNA, 22 nt, Homo sapiens
agagcuuagcugauuggugaac

SEQ ID NO: 599 - RNA, 22 nt, Homo sapiens
cacuagauugugagcuccugga

SEQ ID NO: 600 - RNA, 22 nt, Homo sapiens
aaggagcucacagucuauugag

SEQ ID NO: 601 - RNA, 19 nt, Homo sapiens
ggggccuggcggugggcgg

SEQ ID NO: 602 - RNA, 21 nt, Homo sapiens
guuagggccaacaucucuugg

SEQ ID NO: 603 - RNA, 22 nt, Homo sapiens
gaggguuggguggaggcucucc

SEQ ID NO: 604 - RNA, 23 nt, Homo sapiens
agaauugcguuuggacaaucagu

SEQ ID NO: 605 - RNA, 22 nt, Homo sapiens
agauguccagccacaauucucg

SEQ ID NO: 606 - RNA, 21 nt, Homo sapiens
agggcccccccucaauccugu

SEQ ID NO: 607 - RNA, 21 nt, Homo sapiens
auguaugugugcaugugcaug

SEQ ID NO: 608 - RNA, 24 nt, Homo sapiens
agcagaagcagggagguucuccca

SEQ ID NO: 609 - RNA, 22 nt, Homo sapiens
uaugugggaugguaaaccgcuu

SEQ ID NO: 610 - RNA, 22 nt, Homo sapiens
ugguuuaccgucccacauacau

SEQ ID NO: 611 - RNA, 22 nt, Homo sapiens
uagcaccaucugaaaucgguua

SEQ ID NO: 612 - RNA, 22 nt, Homo sapiens
acugauuucuuuugguguucag

SEQ ID NO: 613 - RNA, 24 nt, Homo sapiens
gcugguuucauauggugguuuaga

SEQ ID NO: 614 - RNA, 22 nt, Homo sapiens
cugguuucacaugguggcuuag

SEQ ID NO: 615 - RNA, 23 nt, Homo sapiens
uagcaccauuugaaaucaguguu

SEQ ID NO: 616 - RNA, 22 nt, Homo sapiens
uagcaccauuugaaaucgguua

SEQ ID NO: 617 - RNA, 22 nt, Homo sapiens
ugaccgauuucuccugguguuc

SEQ ID NO: 618 - RNA, 22 nt, Homo sapiens
uauacaagggcagacucucucu

SEQ ID NO: 619 - RNA, 23 nt, Homo sapiens
cagugcaauaguauugucaaagc

SEQ ID NO: 620 - RNA, 22 nt, Homo sapiens
gcucugacuuuauugcacuacu

SEQ ID NO: 621 - RNA, 23 nt, Homo sapiens
cagugcaaugauauugucaaagc

SEQ ID NO: 622 - RNA, 23 nt, Homo sapiens
uaagugcuuccauguuuugguga

SEQ ID NO: 623 - RNA, 23 nt, Homo sapiens
acuuaaacguggauguacuugcu

SEQ ID NO: 624 - RNA, 23 nt, Homo sapiens
uaagugcuuccauguuuuaguag

SEQ ID NO: 625 - RNA, 22 nt, Homo sapiens
acuuuaacauggaagugcuuuc

SEQ ID NO: 626 - RNA, 23 nt, Homo sapiens
uaagugcuuccauguuucagugg

SEQ ID NO: 627 - RNA, 22 nt, Homo sapiens
uuuaacauggggguaccugcug

SEQ ID NO: 628 - RNA, 23 nt, Homo sapiens
uaagugcuuccauguuugagugu

SEQ ID NO: 629 - RNA, 22 nt, Homo sapiens
acuuuaacauggaggcacuugc

SEQ ID NO: 630 - RNA, 17 nt, Homo sapiens
uaagugcuuccaugcuu

SEQ ID NO: 631 - RNA, 17 nt, Homo sapiens
uaauugcuuccauguuu

SEQ ID NO: 632 - RNA, 23 nt, Homo sapiens
uugccacacugcaacaccuuaca

SEQ ID NO: 633 - RNA, 21 nt, Homo sapiens
ucuggcuguuguggugugcaa

SEQ ID NO: 634 - RNA, 23 nt, Homo sapiens
ucagcaccaggauauuguuggag

SEQ ID NO: 635 - RNA, 23 nt, Homo sapiens
ucaacaaaaucacugaugcugga

SEQ ID NO: 636 - RNA, 22 nt, Homo sapiens
gauaucagcucaguaggcaccg

SEQ ID NO: 637 - RNA, 21 nt, Homo sapiens
guuccugcugaacugagccag

SEQ ID NO: 638 - RNA, 22 nt, Homo sapiens
cuuucagucggauguuugcagc

SEQ ID NO: 639 - RNA, 22 nt, Homo sapiens
uguaaacauccucgacuggaag

SEQ ID NO: 640 - RNA, 22 nt, Homo sapiens
cugggagguggauguuuacuuc

SEQ ID NO: 641 - RNA, 22 nt, Homo sapiens
uguaaacauccuacacucagcu

SEQ ID NO: 642 - RNA, 22 nt, Homo sapiens
cugggagaggguuguuuacucc

SEQ ID NO: 643 - RNA, 22 nt, Homo sapiens
cugggagaaggcuguuuacucu

SEQ ID NO: 644 - RNA, 23 nt, Homo sapiens
uguaaacauccuacacucucagc

SEQ ID NO: 645 - RNA, 22 nt, Homo sapiens
cuuucagucagauguuugcugc

SEQ ID NO: 646 - RNA, 22 nt, Homo sapiens
uguaaacauccccgacuggaag

SEQ ID NO: 647 - RNA, 22 nt, Homo sapiens
cuuucagucggauguuuacagc

SEQ ID NO: 648 - RNA, 22 nt, Homo sapiens
uguaaacauccuugacuggaag

SEQ ID NO: 649 - RNA, 20 nt, Homo sapiens
auauggguuuacuaguuggu

SEQ ID NO: 650 - RNA, 22 nt, Homo sapiens
ugccuggaacauaguagggacu

SEQ ID NO: 651 - RNA, 21 nt, Homo sapiens
auaggacucauauagugccag

SEQ ID NO: 652 - RNA, 20 nt, Homo sapiens
agacacuauacgagucauau

SEQ ID NO: 653 - RNA, 23 nt, Homo sapiens
ugugacugcauuaugaaaauucu

SEQ ID NO: 654 - RNA, 20 nt, Homo sapiens
uggcuuuuaacuuugauggc

SEQ ID NO: 655 - RNA, 21 nt, Homo sapiens
cacagcaaguguagacaggca

SEQ ID NO: 656 - RNA, 21 nt, Homo sapiens
ccugucugugccugcuguaca

SEQ ID NO: 657 - RNA, 22 nt, Homo sapiens
uaaauagaguaggcaaaggaca

SEQ ID NO: 658 - RNA, 22 nt, Homo sapiens
uccuuugccuauucuauuuaag

SEQ ID NO: 659 - RNA, 22 nt, Homo sapiens
guugggacaagaggacggucuu

SEQ ID NO: 660 - RNA, 17 nt, Homo sapiens
cagagaauuguuuaauc

SEQ ID NO: 661 - RNA, 22 nt, Homo sapiens
acuuuccucacucccgugaagu

SEQ ID NO: 662 - RNA, 21 nt, Homo sapiens
uucgcgggcgaaggcaaaguc

SEQ ID NO: 663 - RNA, 20 nt, Homo sapiens
uagaggaagcuguggagaga

SEQ ID NO: 664 - RNA, 22 nt, Homo sapiens
caucuggcauccgucacacaga

SEQ ID NO: 665 - RNA, 22 nt, Homo sapiens
ugagggacagaugccagaagca

SEQ ID NO: 666 - RNA, 22 nt, Homo sapiens
uccccuucugcaggccugcugg

SEQ ID NO: 667 - RNA, 23 nt, Homo sapiens
aucagggcuuguggaaugggaag

SEQ ID NO: 668 - RNA, 23 nt, Homo sapiens
ucuggcaaguaaaaaacucucau

SEQ ID NO: 669 - RNA, 22 nt, Homo sapiens
aaacuaaucucuacacugcugc

SEQ ID NO: 670 - RNA, 22 nt, Homo sapiens
gcaguaguguagagauugguuu

SEQ ID NO: 671 - RNA, 21 nt, Homo sapiens
gcugcaccggagacuggguaa

SEQ ID NO: 672 - RNA, 21 nt, Homo sapiens
uacccagucuccggugcagcc

SEQ ID NO: 673 - RNA, 23 nt, Homo sapiens
ucgaggacugguggaagggccuu

SEQ ID NO: 674 - RNA, 24 nt, Homo sapiens
uggguagagaaggagcucagagga

SEQ ID NO: 675 - RNA, 22 nt, Homo sapiens
uaaagaacucuuaaaacccaau

SEQ ID NO: 676 - RNA, 23 nt, Homo sapiens
ugauggauaaaagacuacauauu

SEQ ID NO: 677 - RNA, 22 nt, Homo sapiens
ugccuaggcugagacugcagug

SEQ ID NO: 678 - RNA, 22 nt, Homo sapiens
ggcuggagcgagugcaguggug

SEQ ID NO: 679 - RNA, 22 nt, Homo sapiens
uggcccaaccuauucaguuagu

SEQ ID NO: 680 - RNA, 23 nt, Homo sapiens
cugacugaauagguagggucauu

SEQ ID NO: 681 - RNA, 24 nt, Homo sapiens
ucuguagccugggagcaauggggu

SEQ ID NO: 682 - RNA, 24 nt, Homo sapiens
uguggacagugagguagagggagu

SEQ ID NO: 683 - RNA, 23 nt, Homo sapiens
uaggagcucaacagaugccuguu

SEQ ID NO: 684 - RNA, 22 nt, Homo sapiens
ugcuaugccaacauauugccau

SEQ ID NO: 685 - RNA, 22 nt, Homo sapiens
agcuuuugggaauucagguagu

SEQ ID NO: 686 - RNA, 21 nt, Homo sapiens
accugaauuaccaaaagcuuu

SEQ ID NO: 687 - RNA, 19 nt, Homo sapiens
gagggcggguggaggagga

SEQ ID NO: 688 - RNA, 22 nt, Homo sapiens
aaggccuuucugaaccuucaga

SEQ ID NO: 689 - RNA, 25 nt, Homo sapiens
auaacauuguaaagcgcuucuuucg

SEQ ID NO: 690 - RNA, 22 nt, Homo sapiens
auauaccuguucggucucuuua

SEQ ID NO: 691 - RNA, 22 nt, Homo sapiens
aggggaccaaagagauauauag

SEQ ID NO: 692 - RNA, 24 nt, Homo sapiens
agauauuuugaguguuuggaauug

SEQ ID NO: 693 - RNA, 22 nt, Homo sapiens
aacuccaaacacucaaaacuca

SEQ ID NO: 694 - RNA, 22 nt, Homo sapiens
caugcuaggauagaaagaaugg

SEQ ID NO: 695 - RNA, 24 nt, Homo sapiens
gguugggcagugaggaggguguga

SEQ ID NO: 696 - RNA, 22 nt, Homo sapiens
uggaaaaaacuggugugugcuu

SEQ ID NO: 697 - RNA, 23 nt, Homo sapiens
uuuguauggauauguguguguau

SEQ ID NO: 698 - RNA, 22 nt, Homo sapiens
cuggggagauccucgagguugg

SEQ ID NO: 699 - RNA, 22 nt, Homo sapiens
caaccucgacgaucuccucagc

SEQ ID NO: 700 - RNA, 21 nt, Homo sapiens
ugaggagaucgucgagguugg

SEQ ID NO: 701 - RNA, 22 nt, Homo sapiens
caaccucgaggaucuccccagc

SEQ ID NO: 702 - RNA, 21 nt, Homo sapiens
gguggggcaaugggaucaggu

SEQ ID NO: 703 - RNA, 22 nt, Homo sapiens
uguguuagaauaggggcaauaa

SEQ ID NO: 704 - RNA, 22 nt, Homo sapiens
auugccucuguucuaacacaag

SEQ ID NO: 705 - RNA, 23 nt, Homo sapiens
ggggaaagcgaguagggacauuu

SEQ ID NO: 706 - RNA, 22 nt, Homo sapiens
cagaaggggaguugggagcaga

SEQ ID NO: 707 - RNA, 21 nt, Homo sapiens
ccaggcucugcagugggaacu

SEQ ID NO: 708 - RNA, 18 nt, Homo sapiens
ccaggcucugcaguggga

SEQ ID NO: 709 - RNA, 21 nt, Homo sapiens
cucccacuuccagaucuuucu

SEQ ID NO: 710 - RNA, 22 nt, Homo sapiens
aaagaucuggaagugggagaca

SEQ ID NO: 711 - RNA, 22 nt, Homo sapiens
cugcccuagucuagcugaagcu

SEQ ID NO: 712 - RNA, 22 nt, Homo sapiens
uucagccaggcuagugcagucu

SEQ ID NO: 713 - RNA, 22 nt, Homo sapiens
aagggcuuccucucugcaggac

SEQ ID NO: 714 - RNA, 21 nt, Homo sapiens
ccugcagagaggaagcccuuc

SEQ ID NO: 715 - RNA, 22 nt, Homo sapiens
uaggauuacaagugucggccac

SEQ ID NO: 716 - RNA, 21 nt, Homo sapiens
aggcaagaugcuggcauagcu

SEQ ID NO: 717 - RNA, 22 nt, Homo sapiens
agagcugagacuagaaagccca

SEQ ID NO: 718 - RNA, 22 nt, Homo sapiens
ggcuuucuagucucagcucucc

SEQ ID NO: 719 - RNA, 23 nt, Homo sapiens
cugauaagaacagaggcccagau

SEQ ID NO: 720 - RNA, 21 nt, Homo sapiens
ucccuaccccuccacucccca

SEQ ID NO: 721 - RNA, 23 nt, Homo sapiens
uuagggaguagaaggguggggag

SEQ ID NO: 722 - RNA, 22 nt, Homo sapiens
uauaaaaugagggcaguaagac

SEQ ID NO: 723 - RNA, 22 nt, Homo sapiens
ugugacuuuaagggaaauggcg

SEQ ID NO: 724 - RNA, 22 nt, Homo sapiens
agguggaugcaaugugaccuca

SEQ ID NO: 725 - RNA, 23 nt, Homo sapiens
cgcagacaaugccuacuggccua

SEQ ID NO: 726 - RNA, 22 nt, Homo sapiens
aggauuucagaaauacuggugu

SEQ ID NO: 727 - RNA, 17 nt, Homo sapiens
gaguucuacagucagac

SEQ ID NO: 728 - RNA, 22 nt, Homo sapiens
uaggacugugcuuggcacauag

SEQ ID NO: 729 - RNA, 22 nt, Homo sapiens
cugggguucugagacagacagu

SEQ ID NO: 730 - RNA, 24 nt, Homo sapiens
agauguauggaaucuguauauauc

SEQ ID NO: 731 - RNA, 22 nt, Homo sapiens
aaaggaggaaauaggcaggcca

SEQ ID NO: 732 - RNA, 22 nt, Homo sapiens
ugcccugccuguuuucuccuuu

SEQ ID NO: 733 - RNA, 23 nt, Homo sapiens
uagugaguuagagaugcagagcc

SEQ ID NO: 734 - RNA, 22 nt, Homo sapiens
cggggagagaacgcagugacgu

SEQ ID NO: 735 - RNA, 19 nt, Homo sapiens
acuggccugggacuaccgg

SEQ ID NO: 736 - RNA, 21 nt, Homo sapiens
ugcacggcacuggggacacgu

SEQ ID NO: 737 - RNA, 23 nt, Homo sapiens
uguguacacacgugccaggcgcu

SEQ ID NO: 738 - RNA, 17 nt, Homo sapiens
ggggcgcggccggaucg

SEQ ID NO: 739 - RNA, 22 nt, Homo sapiens
agaaggggugaaauuuaaacgu

SEQ ID NO: 740 - RNA, 19 nt, Homo sapiens
uggggcggagcuuccggag

SEQ ID NO: 741 - RNA, 22 nt, Homo sapiens
uggggcggagcuuccggaggcc

SEQ ID NO: 742 - RNA, 25 nt, Homo sapiens
cuuccagacgcuccgccccacgucg

SEQ ID NO: 743 - RNA, 19 nt, Homo sapiens
aucgggcccucggcgccgg

SEQ ID NO: 744 - RNA, 17 nt, Homo sapiens
gcuucuguaguguaguc

SEQ ID NO: 745 - RNA, 22 nt, Homo sapiens
gccucucucggagucgcucgga

SEQ ID NO: 746 - RNA, 23 nt, Homo sapiens
aaagucucgcucucugccccuca

SEQ ID NO: 747 - RNA, 24 nt, Homo sapiens
ugaggggccucagaccgagcuuuu

SEQ ID NO: 748 - RNA, 23 nt, Homo sapiens
agaagaaggcggucggucugcgg

SEQ ID NO: 749 - RNA, 21 nt, Homo sapiens
ucacgcggagagauggcuuug

SEQ ID NO: 750 - RNA, 22 nt, Homo sapiens
caggcgucugucuacguggcuu

SEQ ID NO: 751 - RNA, 20 nt, Homo sapiens
uuggccauggggcugcgcgg

SEQ ID NO: 752 - RNA, 23 nt, Homo sapiens
ccugggcagcguguggcugaagg

SEQ ID NO: 753 - RNA, 23 nt, Homo sapiens
agaggcuuugugcggauacgggg

SEQ ID NO: 754 - RNA, 21 nt, Homo sapiens
cccuugggucugaugggguag

SEQ ID NO: 755 - RNA, 25 nt, Homo sapiens
ugccccaucugugcccuggguagga

SEQ ID NO: 756 - RNA, 23 nt, Homo sapiens
uguggaagguagacggccagaga

SEQ ID NO: 757 - RNA, 20 nt, Homo sapiens
ucuggccagcuacgucccca

SEQ ID NO: 758 - RNA, 23 nt, Homo sapiens
uggggacguagcuggccagacag

SEQ ID NO: 759 - RNA, 22 nt, Homo sapiens
cucucuggccgucuaccuucca

SEQ ID NO: 760 - RNA, 23 nt, Homo sapiens
ucugggagguuguagcaguggaa

SEQ ID NO: 761 - RNA, 22 nt, Homo sapiens
uccugcguaggaucugaggagu

SEQ ID NO: 762 - RNA, 22 nt, Homo sapiens
agcucugcugcucacuggcagu

SEQ ID NO: 763 - RNA, 21 nt, Homo sapiens
ggccagccaccaggagggcug

SEQ ID NO: 764 - RNA, 17 nt, Homo sapiens
cgcgccgggcccggguu

SEQ ID NO: 765 - RNA, 18 nt, Homo sapiens
cggggcggcaggggccuc

SEQ ID NO: 766 - RNA, 23 nt, Homo sapiens
ggaggcgcaggcucggaaaggcg

SEQ ID NO: 767 - RNA, 22 nt, Homo sapiens
guggaguccuggggaauggaga

SEQ ID NO: 768 - RNA, 23 nt, Homo sapiens
agggacugccuuaggagaaaguu

SEQ ID NO: 769 - RNA, 22 nt, Homo sapiens
caccuugcgcuacucaggucug

SEQ ID NO: 770 - RNA, 22 nt, Homo sapiens
aaucugagaaggcgcacaaggu

SEQ ID NO: 771 - RNA, 17 nt, Homo sapiens
gggauaugaagaaaaau

SEQ ID NO: 772 - RNA, 22 nt, Homo sapiens
uggaagggagaagagcuuuaau

SEQ ID NO: 773 - RNA, 22 nt, Homo sapiens
aaaagcuggguugagagggcga

SEQ ID NO: 774 - RNA, 22 nt, Homo sapiens
aaaagcuggguugagagggcaa

SEQ ID NO: 775 - RNA, 20 nt, Homo sapiens
aaaagcuggguugagagggu

SEQ ID NO: 776 - RNA, 19 nt, Homo sapiens
aaaagcuggguugagagga

SEQ ID NO: 777 - RNA, 18 nt, Homo sapiens
aaagcuggguugagaagg

SEQ ID NO: 778 - RNA, 21 nt, Homo sapiens
cacauuacacggucgaccucu

SEQ ID NO: 779 - RNA, 22 nt, Homo sapiens
aggugguccguggcgcguucgc

SEQ ID NO: 780 - RNA, 22 nt, Homo sapiens
cccaauacacggucgaccucuu

SEQ ID NO: 781 - RNA, 23 nt, Homo sapiens
agguuguccguggugaguucgca

SEQ ID NO: 782 - RNA, 22 nt, Homo sapiens
caauuuagugugugugauauuu

SEQ ID NO: 783 - RNA, 20 nt, Homo sapiens
acugccccaggugcugcugg

SEQ ID NO: 784 - RNA, 23 nt, Homo sapiens
cgcauccccuagggcauuggugu

SEQ ID NO: 785 - RNA, 23 nt, Homo sapiens
ccuaguagguguccaguaagugu

SEQ ID NO: 786 - RNA, 22 nt, Homo sapiens
uauugcacauuacuaaguugca

SEQ ID NO: 787 - RNA, 20 nt, Homo sapiens
ccucugggcccuuccuccag

SEQ ID NO: 788 - RNA, 22 nt, Homo sapiens
cuggcccucucugcccuuccgu

SEQ ID NO: 789 - RNA, 22 nt, Homo sapiens
aacacaccugguuaaccucuuu

SEQ ID NO: 790 - RNA, 23 nt, Homo sapiens
gcaaagcacacggccugcagaga

SEQ ID NO: 791 - RNA, 22 nt, Homo sapiens
ucucugggccugugucuuaggc

SEQ ID NO: 792 - RNA, 21 nt, Homo sapiens
gccccugggccuauccuagaa

SEQ ID NO: 793 - RNA, 22 nt, Homo sapiens
cuagguauggucccagggaucc

SEQ ID NO: 794 - RNA, 22 nt, Homo sapiens
uuuuucauuauugcuccugacc

SEQ ID NO: 795 - RNA, 23 nt, Homo sapiens
ucaagagcaauaacgaaaaaugu

SEQ ID NO: 796 - RNA, 22 nt, Homo sapiens
cuccuauaugaugccuuucuuc

SEQ ID NO: 797 - RNA, 21 nt, Homo sapiens
gaacggcuucauacaggaguu

SEQ ID NO: 798 - RNA, 22 nt, Homo sapiens
uccagcaucagugauuuuguug

SEQ ID NO: 799 - RNA, 22 nt, Homo sapiens
aacaauauccuggugcugagug

SEQ ID NO: 800 - RNA, 23 nt, Homo sapiens
ugagcgccucgacgacagagccg

SEQ ID NO: 801 - RNA, 23 nt, Homo sapiens
ucccuguccuccaggagcucacg

SEQ ID NO: 802 - RNA, 22 nt, Homo sapiens
caauguuuccacagugcaucac

SEQ ID NO: 803 - RNA, 21 nt, Homo sapiens
gugcauuguaguugcauugca

SEQ ID NO: 804 - RNA, 22 nt, Homo sapiens
cagugccucggcagugcagccc

SEQ ID NO: 805 - RNA, 20 nt, Homo sapiens
gugcauugcuguugcauugc

SEQ ID NO: 806 - RNA, 22 nt, Homo sapiens
uccgucucaguuacuuuauagc

SEQ ID NO: 807 - RNA, 22 nt, Homo sapiens
uuauaaagcaaugagacugauu

SEQ ID NO: 808 - RNA, 23 nt, Homo sapiens
ucucacacagaaaucgcacccgu

SEQ ID NO: 809 - RNA, 21 nt, Homo sapiens
aggggugcuaucugugauuga

SEQ ID NO: 810 - RNA, 22 nt, Homo sapiens
gcccugaacgaggggucuggag

SEQ ID NO: 811 - RNA, 22 nt, Homo sapiens
gcugacuccuaguccagggcuc

SEQ ID NO: 812 - RNA, 23 nt, Homo sapiens
ugucugcccgcaugccugccucu

SEQ ID NO: 813 - RNA, 22 nt, Homo sapiens
caaucagcaaguauacugcccu

SEQ ID NO: 814 - RNA, 22 nt, Homo sapiens
uggcagugucuuagcugguugu

SEQ ID NO: 815 - RNA, 22 nt, Homo sapiens
caaucacuaacuccacugccau

SEQ ID NO: 816 - RNA, 23 nt, Homo sapiens
uaggcagugucauuagcugauug

SEQ ID NO: 817 - RNA, 22 nt, Homo sapiens
aaucacuaaccacacggccagg

SEQ ID NO: 818 - RNA, 23 nt, Homo sapiens
aggcaguguaguuagcugauugc

SEQ ID NO: 819 - RNA, 24 nt, Homo sapiens
aacaacaaaaucacuagucuucca

SEQ ID NO: 820 - RNA, 22 nt, Homo sapiens
agguagacugggauuuguuguu

SEQ ID NO: 821 - RNA, 22 nt, Homo sapiens
aaacaccauugucacacuccac

SEQ ID NO: 822 - RNA, 23 nt, Homo sapiens
uuuagugugauaauggcguuuga

SEQ ID NO: 823 - RNA, 23 nt, Homo sapiens
ccuccguguuaccuguccucuag

SEQ ID NO: 824 - RNA, 23 nt, Homo sapiens
ugaggauggauagcaaggaagcc

SEQ ID NO: 825 - RNA, 21 nt, Homo sapiens
aaaauuucuuucacuacuuag

SEQ ID NO: 826 - RNA, 21 nt, Homo sapiens
uuagugaaggcuauuuuaauu

SEQ ID NO: 827 - RNA, 20 nt, Homo sapiens
acuguaaacgcuuucugaug

SEQ ID NO: 828 - RNA, 22 nt, Homo sapiens
gcaugugaugaagcaaaucagu

SEQ ID NO: 829 - RNA, 24 nt, Homo sapiens
caaagugaugaguaauacuggcug

SEQ ID NO: 830 - RNA, 20 nt, Homo sapiens
gaaucggaaaggaggcgccg

SEQ ID NO: 831 - RNA, 21 nt, Homo sapiens
uugugaagaaagaaauucuua

SEQ ID NO: 832 - RNA, 22 nt, Homo sapiens
aggaggcaucuugagaaaugga

SEQ ID NO: 833 - RNA, 24 nt, Homo sapiens
acaaaaaaaaaagcccaacccuuc

SEQ ID NO: 834 - RNA, 22 nt, Homo sapiens
uguuguacuuuuuuuuuuguuc

SEQ ID NO: 835 - RNA, 23 nt, Homo sapiens
ucccccaggugugauucugauuu

SEQ ID NO: 836 - RNA, 23 nt, Homo sapiens
uagccuucagaucuugguguuuu

SEQ ID NO: 837 - RNA, 23 nt, Homo sapiens
ccacuuggaucugaaggcugccc

SEQ ID NO: 838 - RNA, 21 nt, Homo sapiens
ucucucggcuccucgcggcuc

SEQ ID NO: 839 - RNA, 22 nt, Homo sapiens
uuaucagaaucuccagggguac

SEQ ID NO: 840 - RNA, 23 nt, Homo sapiens
cgagggcauuucaugaugcaggc

SEQ ID NO: 841 - RNA, 22 nt, Homo sapiens
augaagugcacucaugauaugu

SEQ ID NO: 842 - RNA, 23 nt, Homo sapiens
caucagcacccuauguccuuucu

SEQ ID NO: 843 - RNA, 22 nt, Homo sapiens
aaagacauaguugcaagauggg

SEQ ID NO: 844 - RNA, 22 nt, Homo sapiens
ugucuacauuaaugaaaagagc

SEQ ID NO: 845 - RNA, 22 nt, Homo sapiens
gggaccauccugccugcugugg

SEQ ID NO: 846 - RNA, 22 nt, Homo sapiens
ucagcaggcaggcuggugcagc

SEQ ID NO: 847 - RNA, 22 nt, Homo sapiens
ucacccugcaucccgcacccag

SEQ ID NO: 848 - RNA, 22 nt, Homo sapiens
gugggcugggcugggcugggcc

SEQ ID NO: 849 - RNA, 20 nt, Homo sapiens
cgcgggucggggucugcagg

SEQ ID NO: 850 - RNA, 22 nt, Homo sapiens
ucaccugaccucccaugccugu

SEQ ID NO: 851 - RNA, 22 nt, Homo sapiens
caggcacgggagcucaggugag

SEQ ID NO: 852 - RNA, 21 nt, Homo sapiens
ucaccugagcucccgugccug

SEQ ID NO: 853 - RNA, 20 nt, Homo sapiens
aggcaugggaggucagguga

SEQ ID NO: 854 - RNA, 22 nt, Homo sapiens
aacacaccuauucaaggauuca

SEQ ID NO: 855 - RNA, 24 nt, Homo sapiens
aauccuuggaaccuaggugugagu

SEQ ID NO: 856 - RNA, 22 nt, Homo sapiens
aauugcacgguauccaucugua

SEQ ID NO: 857 - RNA, 22 nt, Homo sapiens
cggguggaucacgaugcaauuu

SEQ ID NO: 858 - RNA, 22 nt, Homo sapiens
aaaaugaaaugagcccagccca

SEQ ID NO: 859 - RNA, 21 nt, Homo sapiens
agccgcggggaucgccgaggg

SEQ ID NO: 860 - RNA, 19 nt, Homo sapiens
agggaccugagugucuaag

SEQ ID NO: 861 - RNA, 19 nt, Homo sapiens
aggugugucuguagagucc

SEQ ID NO: 862 - RNA, 24 nt, Homo sapiens
cauagcccggucgcugguacauga

SEQ ID NO: 863 - RNA, 18 nt, Homo sapiens
cggcuggaggugugagga

SEQ ID NO: 864 - RNA, 18 nt, Homo sapiens
cuaagaaguugacugaag

SEQ ID NO: 865 - RNA, 19 nt, Homo sapiens
gacuggacaagcugaggaa

SEQ ID NO: 866 - RNA, 21 nt, Homo sapiens
gcuugucgcugcgguguugcu

SEQ ID NO: 867 - RNA, 17 nt, Homo sapiens
ggcgggugcgggggugg

SEQ ID NO: 868 - RNA, 21 nt, Homo sapiens
ugugucccauuauuggugauu

SEQ ID NO: 869 - RNA, 22 nt, Homo sapiens
uuuaagaaaacaccauggagau

SEQ ID NO: 870 - RNA, 21 nt, Homo sapiens
ugaguguugucuacgagggca

SEQ ID NO: 871 - RNA, 22 nt, Homo sapiens
uaaugccccuaaaaauccuuau

SEQ ID NO: 872 - RNA, 23 nt, Homo sapiens
agggacuuuugggggcagaugug

SEQ ID NO: 873 - RNA, 22 nt, Homo sapiens
uaaugccccuaaaaauccuuau

SEQ ID NO: 874 - RNA, 22 nt, Homo sapiens
agggacuuucaggggcagcugu

SEQ ID NO: 875 - RNA, 21 nt, Homo sapiens
acugacaggagagcauuuuga

SEQ ID NO: 876 - RNA, 22 nt, Homo sapiens
ugaccugggacucggacagcug

SEQ ID NO: 877 - RNA, 24 nt, Homo sapiens
gaaaaugaugaguagugacugaug

SEQ ID NO: 878 - RNA, 23 nt, Homo sapiens
ugagcaccacacaggccgggcgc

SEQ ID NO: 879 - RNA, 21 nt, Homo sapiens
gcuggucugcguggugcucgg

SEQ ID NO: 880 - RNA, 22 nt, Homo sapiens
ucucaggaguaaagacagaguu

SEQ ID NO: 881 - RNA, 22 nt, Homo sapiens
aacucugucuucacucaugagu

SEQ ID NO: 882 - RNA, 18 nt, Homo sapiens
agcaggugcggggcggcg

SEQ ID NO: 883 - RNA, 21 nt, Homo sapiens
cagugcaaguguagaugccga

SEQ ID NO: 884 - RNA, 22 nt, Homo sapiens
accuuccucuccaugggucuuu

SEQ ID NO: 885 - RNA, 22 nt, Homo sapiens
aaagacccauugaggagaaggu

SEQ ID NO: 886 - RNA, 21 nt, Homo sapiens
aauguagagauugaucaaaau

SEQ ID NO: 887 - RNA, 23 nt, Homo sapiens
acggaauauguauacggaauaua

SEQ ID NO: 888 - RNA, 24 nt, Homo sapiens
agagcucacagcuguccuucucua

SEQ ID NO: 889 - RNA, 22 nt, Homo sapiens
aucaaauaaggacuagucugca

SEQ ID NO: 890 - RNA, 23 nt, Homo sapiens
augagacucauguaaaacaucuu

SEQ ID NO: 891 - RNA, 21 nt, Homo sapiens
auggaauguauauacggaaua

SEQ ID NO: 892 - RNA, 22 nt, Homo sapiens
aauugcacuuuagcaaugguga

SEQ ID NO: 893 - RNA, 22 nt, Homo sapiens
auuguagaaccuaagauuggcc

SEQ ID NO: 894 - RNA, 22 nt, Homo sapiens
caucucuaaggaacucccccaa

SEQ ID NO: 895 - RNA, 23 nt, Homo sapiens
uauggggcuucuguagagauuuc

SEQ ID NO: 896 - RNA, 22 nt, Homo sapiens
acuguugcuaauaugcaacucu

SEQ ID NO: 897 - RNA, 20 nt, Homo sapiens
ccguguuucccccacgcuuu

SEQ ID NO: 898 - RNA, 15 nt, Homo sapiens
aggagauccuggguu

SEQ ID NO: 899 - RNA, 22 nt, Homo sapiens
cucgugggcucuggccacggcc

SEQ ID NO: 900 - RNA, 22 nt, Homo sapiens
caguggccagagcccugcagug

SEQ ID NO: 901 - RNA, 22 nt, Homo sapiens
cugcagaguuuguacggaccgg

SEQ ID NO: 902 - RNA, 20 nt, Homo sapiens
uccguacaaacucugcugug

SEQ ID NO: 903 - RNA, 22 nt, Homo sapiens
cuuccccccaguaaucuucauc

SEQ ID NO: 904 - RNA, 23 nt, Homo sapiens
ugaggauauggcagggaagggga

SEQ ID NO: 905 - RNA, 23 nt, Homo sapiens
uuuugcaugacccugggaguagg

SEQ ID NO: 906 - RNA, 22 nt, Homo sapiens
gacucacucacaggauugugca

SEQ ID NO: 907 - RNA, 22 nt, Homo sapiens
acacagugcuucauccacuacu

SEQ ID NO: 908 - RNA, 22 nt, Homo sapiens
uaguggaugaugcacucugugc

SEQ ID NO: 909 - RNA, 21 nt, Homo sapiens
ugaugauacagguggagguag

SEQ ID NO: 910 - RNA, 22 nt, Homo sapiens
cuacuucuaccuguguuaucau

SEQ ID NO: 911 - RNA, 22 nt, Homo sapiens
ugcgacauuggaaguaguauca

SEQ ID NO: 912 - RNA, 21 nt, Homo sapiens
uuagaccuaguacacguccuu

SEQ ID NO: 913 - RNA, 22 nt, Homo sapiens
uuuccuacccuaccugaagacu

SEQ ID NO: 914 - RNA, 22 nt, Homo sapiens
aucuguaagagaaaguaaauga

SEQ ID NO: 915 - RNA, 24 nt, Homo sapiens
cccggacaggcguucgugcgacgu

SEQ ID NO: 916 - RNA, 22 nt, Homo sapiens
uauggaaagacuuugccacucu

SEQ ID NO: 917 - RNA, 21 nt, Homo sapiens
aguggcaaagucuuuccauau

SEQ ID NO: 918 - RNA, 22 nt, Homo sapiens
cugggaggugugauaucguggu

SEQ ID NO: 919 - RNA, 22 nt, Homo sapiens
ugugauaucaugguuccuggga

SEQ ID NO: 920 - RNA, 22 nt, Homo sapiens
cugggaggugugauauuguggu

SEQ ID NO: 921 - RNA, 22 nt, Homo sapiens
ugugauaucaugguuccuggga

SEQ ID NO: 922 - RNA, 22 nt, Homo sapiens
cugggaggugugauauuguggu

SEQ ID NO: 923 - RNA, 22 nt, Homo sapiens
gggaggugugaucucacacucg

SEQ ID NO: 924 - RNA, 22 nt, Homo sapiens
ugugauaucaugguuccuggga

SEQ ID NO: 925 - RNA, 22 nt, Homo sapiens
ugugauaucgugcuuccuggga

SEQ ID NO: 926 - RNA, 23 nt, Homo sapiens
accuggacccagcguagacaaag

SEQ ID NO: 927 - RNA, 22 nt, Homo sapiens
accaagucugcgucauccucuc

SEQ ID NO: 928 - RNA, 23 nt, Homo sapiens
aguggaugauggagacucgguac

SEQ ID NO: 929 - RNA, 24 nt, Homo sapiens
guuccacacugacacugcagaagu

SEQ ID NO: 930 - RNA, 24 nt, Homo sapiens
ccugcuggucaggaguggauacug

SEQ ID NO: 931 - RNA, 21 nt, Homo sapiens
aauaauacaugguugaucuuu

SEQ ID NO: 932 - RNA, 22 nt, Homo sapiens
agaucgaccguguuauauucgc

SEQ ID NO: 933 - RNA, 22 nt, Homo sapiens
gccugcugggguggaaccuggu

SEQ ID NO: 934 - RNA, 20 nt, Homo sapiens
gguauccguuuggggauggu

SEQ ID NO: 935 - RNA, 22 nt, Homo sapiens
gaaggcagcagugcuccccugu

SEQ ID NO: 936 - RNA, 23 nt, Homo sapiens
aagugccgccaucuuuugagugu

SEQ ID NO: 937 - RNA, 20 nt, Homo sapiens
acucaaacugugggggcacu

SEQ ID NO: 938 - RNA, 23 nt, Homo sapiens
aagugcccccacaguuugagugc

SEQ ID NO: 939 - RNA, 22 nt, Homo sapiens
acucaaaagauggcggcacuuu

SEQ ID NO: 940 - RNA, 23 nt, Homo sapiens
aaagugcugcgacauuugagcgu

SEQ ID NO: 941 - RNA, 23 nt, Homo sapiens
gaagugcuucgauuuuggggugu

SEQ ID NO: 942 - RNA, 22 nt, Homo sapiens
acucaaaaugggggcgcuuucc

SEQ ID NO: 943 - RNA, 22 nt, Homo sapiens
cuuaucagauuguauuguaauu

SEQ ID NO: 944 - RNA, 22 nt, Homo sapiens
uuauaauacaaccugauaagug

SEQ ID NO: 945 - RNA, 22 nt, Homo sapiens
cuuagcagguuguauuaucauu

SEQ ID NO: 946 - RNA, 22 nt, Homo sapiens
auauaauacaaccugcuaagug

SEQ ID NO: 947 - RNA, 22 nt, Homo sapiens
cacuuagcagguuguauuauau

SEQ ID NO: 948 - RNA, 22 nt, Homo sapiens
auaauacaaccugcuaagugcu

SEQ ID NO: 949 - RNA, 22 nt, Homo sapiens
uuuguucguucggcucgcguga

SEQ ID NO: 950 - RNA, 21 nt, Homo sapiens
gguagauuuuccuucuauggu

SEQ ID NO: 951 - RNA, 21 nt, Homo sapiens
aucauagaggaaaauccacgu

SEQ ID NO: 952 - RNA, 22 nt, Homo sapiens
guagauucuccuucuaugagua

SEQ ID NO: 953 - RNA, 22 nt, Homo sapiens
aucauagaggaaaauccauguu

SEQ ID NO: 954 - RNA, 22 nt, Homo sapiens
cguggauauuccuucuauguuu

SEQ ID NO: 955 - RNA, 21 nt, Homo sapiens
aacauagaggaaauuccacgu

SEQ ID NO: 956 - RNA, 21 nt, Homo sapiens
gguggauauuccuucuauguu

SEQ ID NO: 957 - RNA, 22 nt, Homo sapiens
aucacacaaaggcaacuuuugu

SEQ ID NO: 958 - RNA, 22 nt, Homo sapiens
agagguugcccuuggugaauuc

SEQ ID NO: 959 - RNA, 21 nt, Homo sapiens
acuggacuuggagucagaagg

SEQ ID NO: 960 - RNA, 22 nt, Homo sapiens
cuccugacuccagguccugugu

SEQ ID NO: 961 - RNA, 19 nt, Homo sapiens
acuggacuuggaggcagaa

SEQ ID NO: 962 - RNA, 25 nt, Homo sapiens
acuggacuuggagucagaagagugg

SEQ ID NO: 963 - RNA, 20 nt, Homo sapiens
acuggacuuggagucagaaa

SEQ ID NO: 964 - RNA, 19 nt, Homo sapiens
acuggacuuggagucagga

SEQ ID NO: 965 - RNA, 20 nt, Homo sapiens
acuggacuuggagccagaag

SEQ ID NO: 966 - RNA, 20 nt, Homo sapiens
acugggcuuggagucagaag

SEQ ID NO: 967 - RNA, 21 nt, Homo sapiens
acuggacuuggugucagaugg

SEQ ID NO: 968 - RNA, 21 nt, Homo sapiens
acuggacuaggagucagaagg

SEQ ID NO: 969 - RNA, 19 nt, Homo sapiens
acuggauuuggagccagaa

SEQ ID NO: 970 - RNA, 22 nt, Homo sapiens
uauguaacaugguccacuaacu

SEQ ID NO: 971 - RNA, 21 nt, Homo sapiens
ugguagacuauggaacguagg

SEQ ID NO: 972 - RNA, 22 nt, Homo sapiens
uauguaauaugguccacaucuu

SEQ ID NO: 973 - RNA, 22 nt, Homo sapiens
ugguugaccauagaacaugcgc

SEQ ID NO: 974 - RNA, 22 nt, Homo sapiens
uauacaagggcaagcucucugu

SEQ ID NO: 975 - RNA, 22 nt, Homo sapiens
agcgagguugcccuuuguauau

SEQ ID NO: 976 - RNA, 21 nt, Homo sapiens
aaucauucacggacaacacuu

SEQ ID NO: 977 - RNA, 22 nt, Homo sapiens
gaaguuguucgugguggauucg

SEQ ID NO: 978 - RNA, 22 nt, Homo sapiens
agaucagaaggugauuguggcu

SEQ ID NO: 979 - RNA, 20 nt, Homo sapiens
auuccuagaaauuguucaua

SEQ ID NO: 980 - RNA, 22 nt, Homo sapiens
aggugcuccaggcuggcucaca

SEQ ID NO: 981 - RNA, 22 nt, Homo sapiens
gagcaauguagguagacuguuu

SEQ ID NO: 982 - RNA, 22 nt, Homo sapiens
uguccucuagggccugcagucu

SEQ ID NO: 983 - RNA, 20 nt, Homo sapiens
aaaggcauaaaaccaagaca

SEQ ID NO: 984 - RNA, 22 nt, Homo sapiens
uguguggauccuggaggaggca

SEQ ID NO: 985 - RNA, 21 nt, Homo sapiens
uaacgcauaauauggacaugu

SEQ ID NO: 986 - RNA, 22 nt, Homo sapiens
agacaucaagaucagucccaaa

SEQ ID NO: 987 - RNA, 22 nt, Homo sapiens
uuugggacugaucuugaugucu

SEQ ID NO: 988 - RNA, 22 nt, Homo sapiens
aaggaaccagaaaaugagaagu

SEQ ID NO: 989 - RNA, 22 nt, Homo sapiens
uugaggaaaagauggucuuauu

SEQ ID NO: 990 - RNA, 26 nt, Homo sapiens
aagaggaagaaauggcugguucucag

SEQ ID NO: 991 - RNA, 20 nt, Homo sapiens
gcucggacugagcagguggg

SEQ ID NO: 992 - RNA, 21 nt, Homo sapiens
acagggccgcagauggagacu

SEQ ID NO: 993 - RNA, 21 nt, Homo sapiens
gcagagaacaaaggacucagu

SEQ ID NO: 994 - RNA, 22 nt, Homo sapiens
acugauuaucuuaacucucuga

SEQ ID NO: 995 - RNA, 23 nt, Homo sapiens
ucucugaguaccauaugccuugu

SEQ ID NO: 996 - RNA, 22 nt, Homo sapiens
ucuggccuugacuugacucuuu

SEQ ID NO: 997 - RNA, 23 nt, Homo sapiens
ucaaggccagaggucccacagca

SEQ ID NO: 998 - RNA, 22 nt, Homo sapiens
aacuaguaauguuggauuaggg

SEQ ID NO: 999 - RNA, 22 nt, Homo sapiens
auauguauaugugacugcuacu

SEQ ID NO: 1000 - RNA, 21 nt, Homo sapiens
acuccaguuuuaguucucuug

SEQ ID NO: 1001 - RNA, 22 nt, Homo sapiens
aagagaacugaaaguggagccu

SEQ ID NO: 1002 - RNA, 21 nt, Homo sapiens
uggccaaaaagcaggcagaga

SEQ ID NO: 1003 - RNA, 22 nt, Homo sapiens
cagguagauauuugauaggcau

SEQ ID NO: 1004 - RNA, 21 nt, Homo sapiens
gccuaucacauaucugccugu

SEQ ID NO: 1005 - RNA, 22 nt, Homo sapiens
ggaggaaccuuggagcuucggc

SEQ ID NO: 1006 - RNA, 23 nt, Homo sapiens
gaggcugaugugaguagaccacu

SEQ ID NO: 1007 - RNA, 22 nt, Homo sapiens
ugcucagguugcacagcuggga

SEQ ID NO: 1008 - RNA, 22 nt, Homo sapiens
ucagguguggaaacugaggcag

SEQ ID NO: 1009 - RNA, 22 nt, Homo sapiens
uguagauacgagcaccagccac

SEQ ID NO: 1010 - RNA, 22 nt, Homo sapiens
uaagggguguauggcagaugca

SEQ ID NO: 1011 - RNA, 23 nt, Homo sapiens
acaggcggcuguagcaauggggg

SEQ ID NO: 1012 - RNA, 22 nt, Homo sapiens
aauucccuuguagauaacccgg

SEQ ID NO: 1013 - RNA, 22 nt, Homo sapiens
uacgcgcagaccacaggauguc

SEQ ID NO: 1014 - RNA, 22 nt, Homo sapiens
cagcccggaucccagcccacuu

SEQ ID NO: 1015 - RNA, 20 nt, Homo sapiens
guggguuggggcgggcucug

SEQ ID NO: 1016 - RNA, 22 nt, Homo sapiens
uuacacacaacugaggaucaua

SEQ ID NO: 1017 - RNA, 21 nt, Homo sapiens
uuucagauaacaguauuacau

SEQ ID NO: 1018 - RNA, 22 nt, Homo sapiens
aagcaauacuguuaccugaaau

SEQ ID NO: 1019 - RNA, 23 nt, Homo sapiens
uagcccccaggcuucacuuggcg

SEQ ID NO: 1020 - RNA, 23 nt, Homo sapiens
uucgggcuggccugcugcuccgg

SEQ ID NO: 1021 - RNA, 21 nt, Homo sapiens
ugugcagcaggccaaccgaga

SEQ ID NO: 1022 - RNA, 23 nt, Homo sapiens
agggcauaggagaggguugauau

SEQ ID NO: 1023 - RNA, 20 nt, Homo sapiens
ggcggcggcggaggcggggg

SEQ ID NO: 1024 - RNA, 22 nt, Homo sapiens
cugccagccccguuccagggca

SEQ ID NO: 1025 - RNA, 23 nt, Homo sapiens
acaaaguacagcauuagccuuag

SEQ ID NO: 1026 - RNA, 23 nt, Homo sapiens
aaaggucauuguaagguuaaugc

SEQ ID NO: 1027 - RNA, 22 nt, Homo sapiens
ugaggcuaaugcacuacuucac

SEQ ID NO: 1028 - RNA, 24 nt, Homo sapiens
uauagagagcaggaagauuaaugu

SEQ ID NO: 1029 - RNA, 23 nt, Homo sapiens
gugcuucaucguaauuaaccuua

SEQ ID NO: 1030 - RNA, 24 nt, Homo sapiens
guggaaagcaugcauccagggugu

SEQ ID NO: 1031 - RNA, 22 nt, Homo sapiens
gaauguugcucggugaaccccu

SEQ ID NO: 1032 - RNA, 23 nt, Homo sapiens
agguuacccgagcaacuuugcau

SEQ ID NO: 1033 - RNA, 21 nt, Homo sapiens
aauauaacacagauggccugu

SEQ ID NO: 1034 - RNA, 22 nt, Homo sapiens
uauguaacacgguccacuaacc

SEQ ID NO: 1035 - RNA, 21 nt, Homo sapiens
uaguagaccguauagcguacg

SEQ ID NO: 1036 - RNA, 23 nt, Homo sapiens
acuucaccugguccacuagccgu

SEQ ID NO: 1037 - RNA, 23 nt, Homo sapiens
aucaacagacauuaauugggcgc

SEQ ID NO: 1038 - RNA, 22 nt, Homo sapiens
acuggacuuagggucagaaggc

SEQ ID NO: 1039 - RNA, 23 nt, Homo sapiens
agcucggucugaggccccucagu

SEQ ID NO: 1040 - RNA, 23 nt, Homo sapiens
ugaggggcagagagcgagacuuu

SEQ ID NO: 1041 - RNA, 21 nt, Homo sapiens
caaaacgugaggcgcugcuau

SEQ ID NO: 1042 - RNA, 22 nt, Homo sapiens
cagcagcaauucauguuuugaa

SEQ ID NO: 1043 - RNA, 17 nt, Homo sapiens
ccugagaaaagggccaa

SEQ ID NO: 1044 - RNA, 19 nt, Homo sapiens
ggccacugagucagcacca

SEQ ID NO: 1045 - RNA, 18 nt, Homo sapiens
agggcauguccagggggu

SEQ ID NO: 1046 - RNA, 22 nt, Homo sapiens
aucgggaaugucguguccgccc

SEQ ID NO: 1047 - RNA, 23 nt, Homo sapiens
gccuggagcuacuccaccaucuc

SEQ ID NO: 1048 - RNA, 17 nt, Homo sapiens
caguguucagagaugga

SEQ ID NO: 1049 - RNA, 23 nt, Homo sapiens
aaugacacgaucacucccguuga

SEQ ID NO: 1050 - RNA, 18 nt, Homo sapiens
aucugaccugaugaaggu

SEQ ID NO: 1051 - RNA, 18 nt, Homo sapiens
ccagagguggggacugag

SEQ ID NO: 1052 - RNA, 17 nt, Homo sapiens
ccccgccaccgccuugg

SEQ ID NO: 1053 - RNA, 22 nt, Homo sapiens
caguugggucuaggggucagga

SEQ ID NO: 1054 - RNA, 19 nt, Homo sapiens
cuuggggcauggaguccca

SEQ ID NO: 1055 - RNA, 16 nt, Homo sapiens
aggaaacagggaccca

SEQ ID NO: 1056 - RNA, 17 nt, Homo sapiens
gacauucagacuaccug

SEQ ID NO: 1057 - RNA, 18 nt, Homo sapiens
auucuaagugccuuggcc

SEQ ID NO: 1058 - RNA, 17 nt, Homo sapiens
acucagucauggucauu

SEQ ID NO: 1059 - RNA, 19 nt, Homo sapiens
cugugggcucagcucuggg

SEQ ID NO: 1060 - RNA, 16 nt, Homo sapiens
cuaggaggccuuggcc

SEQ ID NO: 1061 - RNA, 16 nt, Homo sapiens
uccagcucgguggcac

SEQ ID NO: 1062 - RNA, 21 nt, Homo sapiens
ggcuccuccucucaggaugug

SEQ ID NO: 1063 - RNA, 21 nt, Homo sapiens
gcaggcacagacagcccuggc

SEQ ID NO: 1064 - RNA, 20 nt, Homo sapiens
ucagggagucaggggagggc

SEQ ID NO: 1065 - RNA, 19 nt, Homo sapiens
gggggaagaaaaggugggg

SEQ ID NO: 1066 - RNA, 18 nt, Homo sapiens
cauucaacuagugauugu

SEQ ID NO: 1067 - RNA, 18 nt, Homo sapiens
guguucucugauggacag

SEQ ID NO: 1068 - RNA, 18 nt, Homo sapiens
cagcagucccucccccug

SEQ ID NO: 1069 - RNA, 17 nt, Homo sapiens
ccaauuaccacuucuuu

SEQ ID NO: 1070 - RNA, 17 nt, Homo sapiens
cucagugacucaugugc

SEQ ID NO: 1071 - RNA, 21 nt, Homo sapiens
gcaguucugagcacaguacac

SEQ ID NO: 1072 - RNA, 18 nt, Homo sapiens
cuaggggguuugcccuug

SEQ ID NO: 1073 - RNA, 16 nt, Homo sapiens
cucuccucccggcuuc

SEQ ID NO: 1074 - RNA, 21 nt, Homo sapiens
gaguguaguucugagcagagc

SEQ ID NO: 1075 - RNA, 18 nt, Homo sapiens
gggucccggggagggggg

SEQ ID NO: 1076 - RNA, 18 nt, Homo sapiens
uaaaauuugcauccagga

SEQ ID NO: 1077 - RNA, 17 nt, Homo sapiens
uggggcucagcgaguuu

SEQ ID NO: 1078 - RNA, 18 nt, Homo sapiens
gggcucacaucaccccau

SEQ ID NO: 1079 - RNA, 18 nt, Homo sapiens
gcggcgaguccgacucau

SEQ ID NO: 1080 - RNA, 17 nt, Homo sapiens
accccacuccugguacc

SEQ ID NO: 1081 - RNA, 19 nt, Homo sapiens
ucucccuugagggcacuuu

SEQ ID NO: 1082 - RNA, 17 nt, Homo sapiens
uugucugcugaguuucc

SEQ ID NO: 1083 - RNA, 19 nt, Homo sapiens
gcauugugcagggcuauca

SEQ ID NO: 1084 - RNA, 22 nt, Homo sapiens
uaauacugucugguaaaaccgu

SEQ ID NO: 1085 - RNA, 19 nt, Homo sapiens
ugcccuccuuucuucccuc

SEQ ID NO: 1086 - RNA, 16 nt, Homo sapiens
uucagcaggaacagcu

SEQ ID NO: 1087 - RNA, 18 nt, Homo sapiens
ccccugggccggccuugg

SEQ ID NO: 1088 - RNA, 17 nt, Homo sapiens
cagccugacaggaacag

SEQ ID NO: 1089 - RNA, 17 nt, Homo sapiens
gggagucuacagcaggg

SEQ ID NO: 1090 - RNA, 18 nt, Homo sapiens
cagugcaauguuuuccuu

SEQ ID NO: 1091 - RNA, 17 nt, Homo sapiens
augugggcucaggcuca

SEQ ID NO: 1092 - RNA, 16 nt, Homo sapiens
ugccuuccugucugug

SEQ ID NO: 1093 - RNA, 22 nt, Homo sapiens
cugggacaggaggaggaggcag

SEQ ID NO: 1094 - RNA, 18 nt, Homo sapiens
gcuggugacaugagaggc

SEQ ID NO: 1095 - RNA, 18 nt, Homo sapiens
ugggagcuggacuacuuc

SEQ ID NO: 1096 - RNA, 20 nt, Homo sapiens
ucccacuacuucacuuguga

SEQ ID NO: 1097 - RNA, 18 nt, Homo sapiens
ccaguguggcucagcgag

SEQ ID NO: 1098 - RNA, 17 nt, Homo sapiens
uucugagcugaggacag

SEQ ID NO: 1099 - RNA, 17 nt, Homo sapiens
ccggcauguccagggca

SEQ ID NO: 1100 - RNA, 18 nt, Homo sapiens
ccuagacaccuccaguuc

SEQ ID NO: 1101 - RNA, 17 nt, Homo sapiens
uggagagaaaggcagua

SEQ ID NO: 1102 - RNA, 19 nt, Homo sapiens
aauguuuuuuccuguuucc

SEQ ID NO: 1103 - RNA, 18 nt, Homo sapiens
ucccuggaguuucuucuu

SEQ ID NO: 1104 - RNA, 18 nt, Homo sapiens
cuggagucuaggauucca

SEQ ID NO: 1105 - RNA, 16 nt, Homo sapiens
gcagcauucauguccc

SEQ ID NO: 1106 - RNA, 18 nt, Homo sapiens
gaaagagagcugagugug

SEQ ID NO: 1107 - RNA, 19 nt, Homo sapiens
ggccuuguuccugucccca

SEQ ID NO: 1108 - RNA, 20 nt, Homo sapiens
agcccccuggccccaaaccc

SEQ ID NO: 1109 - RNA, 22 nt, Homo sapiens
caggucgucuugcagggcuucu

SEQ ID NO: 1110 - RNA, 18 nt, Homo sapiens
cucugggaaaugggacag

SEQ ID NO: 1111 - RNA, 18 nt, Homo sapiens
ccgcuuucugagcuggac

SEQ ID NO: 1112 - RNA, 21 nt, Homo sapiens
ugucuugcaggccgucaugca

SEQ ID NO: 1113 - RNA, 17 nt, Homo sapiens
ggugaggcuagcuggug

SEQ ID NO: 1114 - RNA, 17 nt, Homo sapiens
acauugccagggaguuu

SEQ ID NO: 1115 - RNA, 17 nt, Homo sapiens
cacuguggguacaugcu

SEQ ID NO: 1116 - RNA, 17 nt, Homo sapiens
ucccugagcaaagccac

SEQ ID NO: 1117 - RNA, 18 nt, Homo sapiens
gggauucuguagcuuccu

SEQ ID NO: 1118 - RNA, 21 nt, Homo sapiens
uuagcgguggaccgcccugcg

SEQ ID NO: 1119 - RNA, 21 nt, Homo sapiens
cugugggcucagcgcgugggg

SEQ ID NO: 1120 - RNA, 18 nt, Homo sapiens
cagccccacagccucaga

SEQ ID NO: 1121 - RNA, 21 nt, Homo sapiens
cuggauggcuccuccaugucu

SEQ ID NO: 1122 - RNA, 20 nt, Homo sapiens
cccugagacccuaaccuuaa

SEQ ID NO: 1123 - RNA, 18 nt, Homo sapiens
uugcacuugucucaguga

SEQ ID NO: 1124 - RNA, 23 nt, Homo sapiens
ucuuggaguaggucauugggugg

SEQ ID NO: 1125 - RNA, 20 nt, Homo sapiens
uguuccucugucucccagac

SEQ ID NO: 1126 - RNA, 19 nt, Homo sapiens
ggcuugcaugggggacugg

SEQ ID NO: 1127 - RNA, 17 nt, Homo sapiens
ccaguuuucccaggauu

SEQ ID NO: 1128 - RNA, 19 nt, Homo sapiens
ccugagacccuaguuccac

SEQ ID NO: 1129 - RNA, 22 nt, Homo sapiens
aucaugaugggcuccucggugu

SEQ ID NO: 1130 - RNA, 19 nt, Homo sapiens
ccucagaucagagccuugc

SEQ ID NO: 1131 - RNA, 18 nt, Homo sapiens
ggugggcuucccggaggg

SEQ ID NO: 1132 - RNA, 18 nt, Homo sapiens
cacugcaggacucagcag

SEQ ID NO: 1133 - RNA, 17 nt, Homo sapiens
ugagggaggagacugca

SEQ ID NO: 1134 - RNA, 18 nt, Homo sapiens
gaggcugaaggaagaugg

SEQ ID NO: 1135 - RNA, 22 nt, Homo sapiens
gucacugaugucuguagcugag

SEQ ID NO: 1136 - RNA, 22 nt, Homo sapiens
accugucuguggaaaggagcua

SEQ ID NO: 1137 - RNA, 21 nt, Homo sapiens
aaaagcaucaggaaguaccca

SEQ ID NO: 1138 - RNA, 21 nt, Homo sapiens
auaggcaccaaaaagcaacaa

SEQ ID NO: 1139 - RNA, 22 nt, Homo sapiens
aguugccuuuuuguucccaugc

SEQ ID NO: 1140 - RNA, 22 nt, Homo sapiens
agaguuaacucaaaauggacua

SEQ ID NO: 1141 - RNA, 22 nt, Homo sapiens
uguugggauucagcaggaccau

SEQ ID NO: 1142 - RNA, 17 nt, Homo sapiens
gaagauggacguacuuu

SEQ ID NO: 1143 - RNA, 21 nt, Homo sapiens
ucugaauagagucugaagagu

SEQ ID NO: 1144 - RNA, 22 nt, Homo sapiens
caaggagacgggaacauggagc

SEQ ID NO: 1145 - RNA, 20 nt, Homo sapiens
aaaagcugggcugagaggcg

SEQ ID NO: 1146 - RNA, 18 nt, Homo sapiens
aggcuggagugagcggag

SEQ ID NO: 1147 - RNA, 22 nt, Homo sapiens
gcgacucugaaaacuagaaggu

SEQ ID NO: 1148 - RNA, 20 nt, Homo sapiens
aaagacucugcaagaugccu

SEQ ID NO: 1149 - RNA, 21 nt, Homo sapiens
acaggagugggggugggacau

SEQ ID NO: 1150 - RNA, 21 nt, Homo sapiens
cgucccaccccccacuccugu

SEQ ID NO: 1151 - RNA, 18 nt, Homo sapiens
aggagaaguaaaguagaa

SEQ ID NO: 1152 - RNA, 22 nt, Homo sapiens
auggccagagcucacacagagg

SEQ ID NO: 1153 - RNA, 21 nt, Homo sapiens
gcaggacaggcagaaguggau

SEQ ID NO: 1154 - RNA, 22 nt, Homo sapiens
cagggcaggaagaaguggacaa

SEQ ID NO: 1155 - RNA, 22 nt, Homo sapiens
guccacuucugccugcccugcc

SEQ ID NO: 1156 - RNA, 21 nt, Homo sapiens
ugggcucaggguacaaagguu

SEQ ID NO: 1157 - RNA, 21 nt, Homo sapiens
cacaggcuuagaaaagacagu

SEQ ID NO: 1158 - RNA, 22 nt, Homo sapiens
gugacugauaccuuggaggcau

SEQ ID NO: 1159 - RNA, 22 nt, Homo sapiens
ugucguggggcuugcuggcuug

SEQ ID NO: 1160 - RNA, 17 nt, Homo sapiens
acagggaggagauugua

SEQ ID NO: 1161 - RNA, 17 nt, Homo sapiens
gccggacaagagggagg

SEQ ID NO: 1162 - RNA, 17 nt, Homo sapiens
uuggaggcguggguuuu

SEQ ID NO: 1163 - RNA, 18 nt, Homo sapiens
cucgaguuggaagaggcg

SEQ ID NO: 1164 - RNA, 21 nt, Homo sapiens
cacggcaaaagaaacaaucca

SEQ ID NO: 1165 - RNA, 22 nt, Homo sapiens
agauuguuucuuuugccgugca

SEQ ID NO: 1166 - RNA, 22 nt, Homo sapiens
cagggcuggcagugacaugggu

SEQ ID NO: 1167 - RNA, 22 nt, Homo sapiens
auuucccugccauucccuuggc

SEQ ID NO: 1168 - RNA, 17 nt, Homo sapiens
ggugggggcuguuguuu

SEQ ID NO: 1169 - RNA, 20 nt, Homo sapiens
ggcuccuuggucuaggggua

SEQ ID NO: 1170 - RNA, 22 nt, Homo sapiens
cgucccggggcugcgcgaggca

SEQ ID NO: 1171 - RNA, 22 nt, Homo sapiens
uggggauuuggagaagugguga

SEQ ID NO: 1172 - RNA, 17 nt, Homo sapiens
ugguagagcugaggaca

SEQ ID NO: 1173 - RNA, 23 nt, Homo sapiens
uugaauucuuggccuuaagugau

SEQ ID NO: 1174 - RNA, 20 nt, Homo sapiens
gagcuuggucuguagcgguu

SEQ ID NO: 1175 - RNA, 20 nt, Homo sapiens
ggauccgagucacggcacca

SEQ ID NO: 1176 - RNA, 17 nt, Homo sapiens
aggguguguguguuuuu

SEQ ID NO: 1177 - RNA, 17 nt, Homo sapiens
ccugguggcuuccuuuu

SEQ ID NO: 1178 - RNA, 22 nt, Homo sapiens
ucacaagguauugacuggcgua

SEQ ID NO: 1179 - RNA, 19 nt, Homo sapiens
agagguagguguggaagaa

SEQ ID NO: 1180 - RNA, 22 nt, Homo sapiens
ccaggaggcggaggagguggag

SEQ ID NO: 1181 - RNA, 22 nt, Homo sapiens
auagugguugugaauuuaccuu

SEQ ID NO: 1182 - RNA, 23 nt, Homo sapiens
gauugagacuaguagggcuaggc

SEQ ID NO: 1183 - RNA, 23 nt, Homo sapiens
ugacacggaggguggcuugggaa

SEQ ID NO: 1184 - RNA, 17 nt, Homo sapiens
gagacugggguggggcc

SEQ ID NO: 1185 - RNA, 21 nt, Homo sapiens
aagguuuggauagaugcaaua

SEQ ID NO: 1186 - RNA, 22 nt, Homo sapiens
cucaaguagucugaccagggga

SEQ ID NO: 1187 - RNA, 18 nt, Homo sapiens
gggugcgggccggcgggg

SEQ ID NO: 1188 - RNA, 22 nt, Homo sapiens
uggcggcgguaguuaugggcuu

SEQ ID NO: 1189 - RNA, 18 nt, Homo sapiens
agagcagaaggaugagau

SEQ ID NO: 1190 - RNA, 22 nt, Homo sapiens
gcucccucuagggucgcucgga

SEQ ID NO: 1191 - RNA, 21 nt, Homo sapiens
uggcaaacguggaagccgaga

SEQ ID NO: 1192 - RNA, 22 nt, Homo sapiens
ggaaagcuaggaggcuguacag

SEQ ID NO: 1193 - RNA, 21 nt, Homo sapiens
gaaagacaguagauuguauag

SEQ ID NO: 1194 - RNA, 22 nt, Homo sapiens
aacuauacaaccuacuaccuca

SEQ ID NO: 1195 - RNA, 22 nt, Homo sapiens
gggaaggcaguagguuguauag

SEQ ID NO: 1196 - RNA, 22 nt, Homo sapiens
aaccacacaaccuacuaccuca

SEQ ID NO: 1197 - RNA, 22 nt, Homo sapiens
aaccauacaaccuacuaccuca

SEQ ID NO: 1198 - RNA, 22 nt, Homo sapiens
agaaaggcagcaggucguauag

SEQ ID NO: 1199 - RNA, 22 nt, Homo sapiens
aacuaugcaaccuacuaccucu

SEQ ID NO: 1200 - RNA, 22 nt, Homo sapiens
ggaaagcuaggaggccguauag

SEQ ID NO: 1201 - RNA, 22 nt, Homo sapiens
aacuauacaaccuccuaccuca

SEQ ID NO: 1202 - RNA, 22 nt, Homo sapiens
gggaaggcaauagauuguauag

SEQ ID NO: 1203 - RNA, 22 nt, Homo sapiens
ggaaagacaguagacuguauag

SEQ ID NO: 1204 - RNA, 22 nt, Homo sapiens
aacuauacaaucuacuaccuca

SEQ ID NO: 1205 - RNA, 21 nt, Homo sapiens
gcaaggcaguggccuguacag

SEQ ID NO: 1206 - RNA, 22 nt, Homo sapiens
aacuguacaaacuacuaccuca

SEQ ID NO: 1207 - RNA, 22 nt, Homo sapiens
agcaaggcaguagcuugcgcag

SEQ ID NO: 1208 - RNA, 22 nt, Homo sapiens
aacagcacaaacuacuaccuca

SEQ ID NO: 1209 - RNA, 22 nt, Homo sapiens
auacauacuucuuuacauucca

SEQ ID NO: 1210 - RNA, 22 nt, Homo sapiens
cauaccuauagauacaagcuug

SEQ ID NO: 1211 - RNA, 22 nt, Homo sapiens
cacaaguucggaucuacggguu

SEQ ID NO: 1212 - RNA, 21 nt, Homo sapiens
uucaguuaucacaguacugua

SEQ ID NO: 1213 - RNA, 22 nt, Homo sapiens
agcaucagcacugugauaacug

SEQ ID NO: 1214 - RNA, 23 nt, Homo sapiens
caaggcagcacuguaaagaagcu

SEQ ID NO: 1215 - RNA, 23 nt, Homo sapiens
ucauagcccuguacaaugcugcu

SEQ ID NO: 1216 - RNA, 23 nt, Homo sapiens
agcagcauuguacagggcuauga

SEQ ID NO: 1217 - RNA, 22 nt, Homo sapiens
uagcacaugcucaaacauccgu

SEQ ID NO: 1218 - RNA, 23 nt, Homo sapiens
accacaggagucugagcauuuga

SEQ ID NO: 1219 - RNA, 22 nt, Homo sapiens
guaagaagugcuuacauugcag

SEQ ID NO: 1220 - RNA, 23 nt, Homo sapiens
cuaccugcacuguaagcacuuuu

SEQ ID NO: 1221 - RNA, 22 nt, Homo sapiens
gcagcaaguacccacagugcgg

SEQ ID NO: 1222 - RNA, 21 nt, Homo sapiens
aucugcacugucagcacuuua

SEQ ID NO: 1223 - RNA, 23 nt, Homo sapiens
ugauagcccuguacaaugcugcu

SEQ ID NO: 1224 - RNA, 22 nt, Homo sapiens
uauuccccuagauacgaauuug

SEQ ID NO: 1225 - RNA, 23 nt, Homo sapiens
cacaaauucggaucuacagggua

SEQ ID NO: 1226 - RNA, 22 nt, Homo sapiens
auuccccuagaaucgaaucugu

SEQ ID NO: 1227 - RNA, 23 nt, Homo sapiens
cacaaauucgguucuacagggua

SEQ ID NO: 1228 - RNA, 21 nt, Homo sapiens
cuagggaagaacagugagcaa

SEQ ID NO: 1229 - RNA, 18 nt, Homo sapiens
caugcucagcugacccug

SEQ ID NO: 1230 - RNA, 21 nt, Homo sapiens
ccaaccaaugaaagaaugcuu

SEQ ID NO: 1231 - RNA, 22 nt, Homo sapiens
acacacccacgcgagccggaaa

SEQ ID NO: 1232 - RNA, 21 nt, Homo sapiens
cggcucggguggcggcgacgg

SEQ ID NO: 1233 - RNA, 23 nt, Homo sapiens
gucacaucccucccaagacccuc

SEQ ID NO: 1234 - RNA, 27 nt, Homo sapiens
ugcccacucucaccaucaccuacagug

SEQ ID NO: 1235 - RNA, 23 nt, Homo sapiens
ggaagccaucaagucgcugcagg

SEQ ID NO: 1236 - RNA, 22 nt, Homo sapiens
auaagagucucccccuguauau

SEQ ID NO: 1237 - RNA, 22 nt, Homo sapiens
augagagucucccccuguauau

SEQ ID NO: 1238 - RNA, 21 nt, Homo sapiens
aacauacaaaggguauccucu

SEQ ID NO: 1239 - RNA, 23 nt, Homo sapiens
gcacgucaccggucuaccauccc

SEQ ID NO: 1240 - RNA, 21 nt, Homo sapiens
agaaguagaccauguguccua

SEQ ID NO: 1241 - RNA, 22 nt, Homo sapiens
gaggcucagaauggcucaggag

SEQ ID NO: 1242 - RNA, 21 nt, Homo sapiens
cucccccacugcagcuggcac

SEQ ID NO: 1243 - RNA, 21 nt, Homo sapiens
gagcugcauccuggcuccggg

SEQ ID NO: 1244 - RNA, 21 nt, Homo sapiens
auaauggagaccaggccacga

SEQ ID NO: 1245 - RNA, 20 nt, Homo sapiens
cucaaagcaaacccugcaga

SEQ ID NO: 1246 - RNA, 21 nt, Homo sapiens
gcuuaaacaucuacaugaaca

SEQ ID NO: 1247 - RNA, 18 nt, Homo sapiens
gaaaugagggccagcuga

SEQ ID NO: 1248 - RNA, 21 nt, Homo sapiens
ccccucccagccucccugcca

SEQ ID NO: 1249 - RNA, 20 nt, Homo sapiens
uccgccugucugaacaguga

SEQ ID NO: 1250 - RNA, 22 nt, Homo sapiens
uauuuagugugauaauggcguu

SEQ ID NO: 1251 - RNA, 21 nt, Homo sapiens
cugaggagagaggaggugggg

SEQ ID NO: 1252 - RNA, 19 nt, Homo sapiens
ccaccucccgaguccucac

SEQ ID NO: 1253 - RNA, 22 nt, Homo sapiens
cugggggcggcacaggggcuca

SEQ ID NO: 1254 - RNA, 22 nt, Homo sapiens
ccccccacugggccguacccac

SEQ ID NO: 1255 - RNA, 22 nt, Homo sapiens
caaacaccauugucacacucca

SEQ ID NO: 1256 - RNA, 22 nt, Homo sapiens
cuagggaacacagggcugguga

SEQ ID NO: 1257 - RNA, 26 nt, Homo sapiens
ccccauccaggccugcaugcccucac

SEQ ID NO: 1258 - RNA, 20 nt, Homo sapiens
cuggggaaaaggguggcacg

SEQ ID NO: 1259 - RNA, 17 nt, Homo sapiens
ccaccgccuggccccac

SEQ ID NO: 1260 - RNA, 20 nt, Homo sapiens
ggggggcgaggcagguguga

SEQ ID NO: 1261 - RNA, 21 nt, Homo sapiens
cacacaccugcccccgcccac

SEQ ID NO: 1262 - RNA, 23 nt, Homo sapiens
cugugggagggcaguggugagag

SEQ ID NO: 1263 - RNA, 24 nt, Homo sapiens
cgcucucccccaaacccuacccac

SEQ ID NO: 1264 - RNA, 20 nt, Homo sapiens
gcagcuguccgcccagacac

SEQ ID NO: 1265 - RNA, 22 nt, Homo sapiens
ugccgugcccuggccucccacu

SEQ ID NO: 1266 - RNA, 20 nt, Homo sapiens
cugcgggaggacagggcuca

SEQ ID NO: 1267 - RNA, 22 nt, Homo sapiens
gugggguggguggucaggccga

SEQ ID NO: 1268 - RNA, 21 nt, Homo sapiens
cggcccccccccccccccccc

SEQ ID NO: 1269 - RNA, 22 nt, Homo sapiens
cuggagagacaaggggaagagg

SEQ ID NO: 1270 - RNA, 22 nt, Homo sapiens
uccccauuuccccugucacuca

SEQ ID NO: 1271 - RNA, 21 nt, Homo sapiens
cugggggacggagcagaagga

SEQ ID NO: 1272 - RNA, 21 nt, Homo sapiens
cgcgcuucggccccgcccccg

SEQ ID NO: 1273 - RNA, 20 nt, Homo sapiens
ggggcagacagacgaggaag

SEQ ID NO: 1274 - RNA, 23 nt, Homo sapiens
cacacacuggggcucccacucac

SEQ ID NO: 1275 - RNA, 22 nt, Homo sapiens
cacuccuauaauugauccaguu

SEQ ID NO: 1276 - RNA, 20 nt, Homo sapiens
ggcauucaccgcgugccuua

SEQ ID NO: 1277 - RNA, 26 nt, Homo sapiens
aaccaucucauacaaaccaacuacuu

SEQ ID NO: 1278 - RNA, 21 nt, Homo sapiens
auguaggccuuuagaucacuu

SEQ ID NO: 1279 - RNA, 22 nt, Homo sapiens
uauaggccuuuagaucaucuga

SEQ ID NO: 1280 - RNA, 21 nt, Homo sapiens
uuuaagugaucuaaaggccua

SEQ ID NO: 1281 - RNA, 22 nt, Homo sapiens
aucaagguccgcugugaacacg

SEQ ID NO: 1282 - RNA, 19 nt, Homo sapiens
ccugcuccaaaaauccauu

SEQ ID NO: 1283 - RNA, 24 nt, Homo sapiens
gcuccagucucgacguucccgggg

SEQ ID NO: 1284 - RNA, 22 nt, Homo sapiens
uccggggacgaacgggacgggu

SEQ ID NO: 1285 - RNA, 27 nt, Homo sapiens
uuuagcacagugcuuauacaagaaggu

SEQ ID NO: 1286 - RNA, 22 nt, Homo sapiens
ugaagaagggggggaagggcgu

SEQ ID NO: 1287 - RNA, 21 nt, Homo sapiens
aaaggccacauccagcaccgu

SEQ ID NO: 1288 - RNA, 21 nt, Homo sapiens
agcgccuuuggcagcuagagu

SEQ ID NO: 1289 - RNA, 22 nt, Homo sapiens
uaaaugaauucaauuuccuucu

SEQ ID NO: 1290 - RNA, 21 nt, Homo sapiens
ugcaggcugaucuucuucucu

SEQ ID NO: 1291 - RNA, 24 nt, Homo sapiens
acugcaggcuccagcuuccaggcu

SEQ ID NO: 1292 - RNA, 23 nt, Homo sapiens
aaucuacuuucuuugcucauccu

SEQ ID NO: 1293 - RNA, 22 nt, Homo sapiens
uggaugagcaaagaaagugguu

SEQ ID NO: 1294 - RNA, 22 nt, Homo sapiens
aaccacuuucuuugcucauccg

SEQ ID NO: 1295 - RNA, 22 nt, Homo sapiens
agcuagugagaagucaaugccu

SEQ ID NO: 1296 - RNA, 21 nt, Homo sapiens
ggucagaacccaucauucacu

SEQ ID NO: 1297 - RNA, 21 nt, Homo sapiens
uuccacgaccuaauccuaacu

SEQ ID NO: 1298 - RNA, 22 nt, Homo sapiens
ggcucccaagaaccucaccugu

SEQ ID NO: 1299 - RNA, 24 nt, Homo sapiens
ucacagguuaaagggucucaggga

SEQ ID NO: 1300 - RNA, 22 nt, Homo sapiens
agcucccaagagccuaacccgu

SEQ ID NO: 1301 - RNA, 22 nt, Homo sapiens
gucccaagagccugacuuguga

SEQ ID NO: 1302 - RNA, 22 nt, Homo sapiens
ucacaaguuagggucucaggga

SEQ ID NO: 1303 - RNA, 18 nt, Homo sapiens
ugguggcagaggugggau

SEQ ID NO: 1304 - RNA, 19 nt, Homo sapiens
augguggcaguggugggau

SEQ ID NO: 1305 - RNA, 19 nt, Homo sapiens
aagccaaagccuuauccau

SEQ ID NO: 1306 - RNA, 22 nt, Homo sapiens
auccuucuacaaauucacccau

SEQ ID NO: 1307 - RNA, 22 nt, Homo sapiens
acucaguaugccaggguaccau

SEQ ID NO: 1308 - RNA, 22 nt, Homo sapiens
cgcauuauuacucacgguacga

SEQ ID NO: 1309 - RNA, 23 nt, Homo sapiens
aacaggugcucaaauaagacuug

SEQ ID NO: 1310 - RNA, 22 nt, Homo sapiens
aacaacacuugaccacauccug

SEQ ID NO: 1311 - RNA, 21 nt, Homo sapiens
cgcguaccaaaaguaauaaug

SEQ ID NO: 1312 - RNA, 23 nt, Homo sapiens
agcccuguucuacagcccugagg

SEQ ID NO: 1313 - RNA, 21 nt, Homo sapiens
uggggauuacacuucaacagg

SEQ ID NO: 1314 - RNA, 18 nt, Homo sapiens
cccccaccaccacgcccg

SEQ ID NO: 1315 - RNA, 20 nt, Homo sapiens
cacccccaccaccacgcccg

SEQ ID NO: 1316 - RNA, 22 nt, Homo sapiens
ccaguagcacggcucaguccag

SEQ ID NO: 1317 - RNA, 22 nt, Homo sapiens
ccaguagcauggcucaguccag

SEQ ID NO: 1318 - RNA, 23 nt, Homo sapiens
acacagcucuuccauaucuccag

SEQ ID NO: 1319 - RNA, 22 nt, Homo sapiens
ugccuggcacauagcaggcacu

SEQ ID NO: 1320 - RNA, 22 nt, Homo sapiens
ugagugcuugcuaggugccaag

SEQ ID NO: 1321 - RNA, 26 nt, Homo sapiens
uuucagaauuugcugccaucaucauc

SEQ ID NO: 1322 - RNA, 25 nt, Homo sapiens
aagaaagagucuugcuuugucgccc

SEQ ID NO: 1323 - RNA, 22 nt, Homo sapiens
gacagggucucguuuugucgcc

SEQ ID NO: 1324 - RNA, 25 nt, Homo sapiens
acugcagccucaaccucauggguuc

SEQ ID NO: 1325 - RNA, 22 nt, Homo sapiens
uccacuuccuggguucaagcaa

SEQ ID NO: 1326 - RNA, 19 nt, Homo sapiens
cacugcaaccuccaucucc

SEQ ID NO: 1327 - RNA, 21 nt, Homo sapiens
cucaggcuggagugcaguggu

SEQ ID NO: 1328 - RNA, 22 nt, Homo sapiens
acuuacugcagccucaaccacc

SEQ ID NO: 1329 - RNA, 22 nt, Homo sapiens
agccaagcucagacggauccga

SEQ ID NO: 1330 - RNA, 17 nt, Homo sapiens
gacagccucucccccac

SEQ ID NO: 1331 - RNA, 22 nt, Homo sapiens
aucagagcccucugagcuucag

SEQ ID NO: 1332 - RNA, 20 nt, Homo sapiens
ugucuccacagggcucuuua

SEQ ID NO: 1333 - RNA, 22 nt, Homo sapiens
aaaauacauauauaucuacgua

SEQ ID NO: 1334 - RNA, 22 nt, Homo sapiens
gcucuuuucauuaauguagaca

SEQ ID NO: 1335 - RNA, 22 nt, Homo sapiens
auagaugauaugcacaguacua

SEQ ID NO: 1336 - RNA, 17 nt, Homo sapiens
agaaagaagcaauauga

SEQ ID NO: 1337 - RNA, 21 nt, Homo sapiens
aaagagaccgguucacuguga

SEQ ID NO: 1338 - RNA, 17 nt, Homo sapiens
gggagaggaggaggcga

SEQ ID NO: 1339 - RNA, 20 nt, Homo sapiens
aagcagaaaaaggcaaacga

SEQ ID NO: 1340 - RNA, 22 nt, Homo sapiens
agaaagcgcuuuccuuuguaga

SEQ ID NO: 1341 - RNA, 22 nt, Homo sapiens
gaaaagccagggucuguauaga

SEQ ID NO: 1342 - RNA, 22 nt, Homo sapiens
aggucucacuuuguugcccaga

SEQ ID NO: 1343 - RNA, 21 nt, Homo sapiens
ccugggcaacaaagugagauc

SEQ ID NO: 1344 - RNA, 21 nt, Homo sapiens
agggcucaucuugguccugca

SEQ ID NO: 1345 - RNA, 22 nt, Homo sapiens
gacucgaaccacugauccagca

SEQ ID NO: 1346 - RNA, 21 nt, Homo sapiens
ucuccagaucagggcagucca

SEQ ID NO: 1347 - RNA, 23 nt, Homo sapiens
aaaaugcagauuccuggacucca

SEQ ID NO: 1348 - RNA, 19 nt, Homo sapiens
ucccugauccaaaaaucca

SEQ ID NO: 1349 - RNA, 24 nt, Homo sapiens
acugcuggucuucagucagggcca

SEQ ID NO: 1350 - RNA, 22 nt, Homo sapiens
auacuuuuugggguaagggcuu

SEQ ID NO: 1351 - RNA, 20 nt, Homo sapiens
gaacgggagccggggcgcga

SEQ ID NO: 1352 - RNA, 22 nt, Homo sapiens
augcuuuuugggguaagggcuu

SEQ ID NO: 1353 - RNA, 25 nt, Homo sapiens
cagcgucugccggaacccguuccca

SEQ ID NO: 1354 - RNA, 22 nt, Homo sapiens
gcacaaaucuccagaccaccca

SEQ ID NO: 1355 - RNA, 22 nt, Homo sapiens
agacaacaaugccaaccucaca

SEQ ID NO: 1356 - RNA, 21 nt, Homo sapiens
ucacccagaucugcggccuaa

SEQ ID NO: 1357 - RNA, 22 nt, Homo sapiens
uugcccagauccguggccuauu

SEQ ID NO: 1358 - RNA, 21 nt, Homo sapiens
auuaggccgcagaucugggug

SEQ ID NO: 1359 - RNA, 21 nt, Homo sapiens
gcaagcccagaccgcaaaaag

SEQ ID NO: 1360 - RNA, 22 nt, Homo sapiens
ggagauggagccagggcccuaa

SEQ ID NO: 1361 - RNA, 17 nt, Homo sapiens
caccugaauuacuugaa

SEQ ID NO: 1362 - RNA, 22 nt, Homo sapiens
uacaucuggacagccgaaugaa

SEQ ID NO: 1363 - RNA, 22 nt, Homo sapiens
ucccucacacagaauuccagaa

SEQ ID NO: 1364 - RNA, 24 nt, Homo sapiens
gaagucacucccaggcagcugcaa

SEQ ID NO: 1365 - RNA, 21 nt, Homo sapiens
uuuagcauaaguaugucccaa

SEQ ID NO: 1366 - RNA, 22 nt, Homo sapiens
agagcaagaccccgucucuaaa

SEQ ID NO: 1367 - RNA, 22 nt, Homo sapiens
gggguucgaggcuacagugaga

SEQ ID NO: 1368 - RNA, 22 nt, Homo sapiens
cacaucucacuguagccucaaa

SEQ ID NO: 1369 - RNA, 22 nt, Homo sapiens
ucucucccauuagaguugaaaa

SEQ ID NO: 1370 - RNA, 18 nt, Homo sapiens
caccaccagagccaacgu

SEQ ID NO: 1371 - RNA, 22 nt, Homo sapiens
uggacguuugcaggggaggugg

SEQ ID NO: 1372 - RNA, 22 nt, Homo sapiens
cacgaccgacgccacgccgagu

SEQ ID NO: 1373 - RNA, 21 nt, Homo sapiens
agccggucgagguccggucga

SEQ ID NO: 1374 - RNA, 22 nt, Homo sapiens
augcccuuuuaacauugcacug

SEQ ID NO: 1375 - RNA, 22 nt, Homo sapiens
gcagacaguagcacaaugugaa

SEQ ID NO: 1376 - RNA, 22 nt, Homo sapiens
augcccuuucaucauugcacug

SEQ ID NO: 1377 - RNA, 21 nt, Homo sapiens
guagugcaacagggaaagagu

SEQ ID NO: 1378 - RNA, 18 nt, Homo sapiens
aucacauucaccucccug

SEQ ID NO: 1379 - RNA, 19 nt, Homo sapiens
cagcaucagcagcaucauc

SEQ ID NO: 1380 - RNA, 22 nt, Homo sapiens
agaaaaugccccucaguuuuga

SEQ ID NO: 1381 - RNA, 22 nt, Homo sapiens
cgaccauggcuguagacuguua

SEQ ID NO: 1382 - RNA, 24 nt, Homo sapiens
gaaagugcauagaauucugucugg

SEQ ID NO: 1383 - RNA, 22 nt, Homo sapiens
aguaacaaucgaaagccacggu

SEQ ID NO: 1384 - RNA, 22 nt, Homo sapiens
cagcugguugaaggggaccaaa

SEQ ID NO: 1385 - RNA, 22 nt, Homo sapiens
uagcugguugaaggggaccaaa

SEQ ID NO: 1386 - RNA, 22 nt, Homo sapiens
ccccucuggucaaccagucaca

SEQ ID NO: 1387 - RNA, 22 nt, Homo sapiens
gcgagagugcgggccccaggag

SEQ ID NO: 1388 - RNA, 22 nt, Homo sapiens
cgccacggcuccaaucccuaua

SEQ ID NO: 1389 - RNA, 23 nt, Homo sapiens
ucacauaggaauaaaaagccaua

SEQ ID NO: 1390 - RNA, 22 nt, Homo sapiens
cccauggcuuuuagcccuacau

SEQ ID NO: 1391 - RNA, 23 nt, Homo sapiens
ucacauaggaaugaaaagccaua

SEQ ID NO: 1392 - RNA, 22 nt, Homo sapiens
agacucauuugagacgaugaug

SEQ ID NO: 1393 - RNA, 23 nt, Homo sapiens
uccaucaucaaaacaaauggagu

SEQ ID NO: 1394 - RNA, 23 nt, Homo sapiens
cuacgcguauucuuaagcaauaa

SEQ ID NO: 1395 - RNA, 22 nt, Homo sapiens
ggcccugguguugugaaguagc

SEQ ID NO: 1396 - RNA, 22 nt, Homo sapiens
aacccuggugucgugaaauagc

SEQ ID NO: 1397 - RNA, 23 nt, Homo sapiens
cggccugauucacaacaccagcu

SEQ ID NO: 1398 - RNA, 23 nt, Homo sapiens
acuccaacagggccgcgucucca

SEQ ID NO: 1399 - RNA, 23 nt, Homo sapiens
acuggagacacgugcacuguaga

SEQ ID NO: 1400 - RNA, 21 nt, Homo sapiens
ccgugguucuacccuguggua

SEQ ID NO: 1401 - RNA, 22 nt, Homo sapiens
cuaccauaggguaaaaccacug

SEQ ID NO: 1402 - RNA, 22 nt, Homo sapiens
ccaucuuuaccagacaguguua

SEQ ID NO: 1403 - RNA, 22 nt, Homo sapiens
uccaacacuguacuggaagaug

SEQ ID NO: 1404 - RNA, 23 nt, Homo sapiens
uccauaaaguaggaaacacuaca

SEQ ID NO: 1405 - RNA, 21 nt, Homo sapiens
aguagugcuuucuacuuuaug

SEQ ID NO: 1406 - RNA, 21 nt, Homo sapiens
gagcuacagugcuucaucuca

SEQ ID NO: 1407 - RNA, 22 nt, Homo sapiens
accagagaugcagcacugcacc

SEQ ID NO: 1408 - RNA, 20 nt, Homo sapiens
aguacaucaucuauacugua

SEQ ID NO: 1409 - RNA, 22 nt, Homo sapiens
cuuacaguauaugaugauaucc

SEQ ID NO: 1410 - RNA, 22 nt, Homo sapiens
agaacaguauuuccaggaaucc

SEQ ID NO: 1411 - RNA, 23 nt, Homo sapiens
agggauuccugggaaaacuggac

SEQ ID NO: 1412 - RNA, 21 nt, Homo sapiens
cagcgaaacaggcaaacggag

SEQ ID NO: 1413 - RNA, 22 nt, Homo sapiens
ggagcccgcgccccgcgccgag

SEQ ID NO: 1414 - RNA, 22 nt, Homo sapiens
cugaagaacugaauuucagagg

SEQ ID NO: 1415 - RNA, 22 nt, Homo sapiens
aacccauggaauucaguucuca

SEQ ID NO: 1416 - RNA, 22 nt, Homo sapiens
ccagaacugaguccacagggca

SEQ ID NO: 1417 - RNA, 22 nt, Homo sapiens
agccuauggaauucaguucuca

SEQ ID NO: 1418 - RNA, 21 nt, Homo sapiens
cggggugcacgggcggagggc

SEQ ID NO: 1419 - RNA, 22 nt, Homo sapiens
acaccuggcuccacacgcgggc

SEQ ID NO: 1420 - RNA, 20 nt, Homo sapiens
gcagaagcauuuccacacac

SEQ ID NO: 1421 - RNA, 22 nt, Homo sapiens
uagcagaagcauuuccgcacac

SEQ ID NO: 1422 - RNA, 22 nt, Homo sapiens
acaaaguucuguagugcacuga

SEQ ID NO: 1423 - RNA, 22 nt, Homo sapiens
agucggagugucucagaacuuu

SEQ ID NO: 1424 - RNA, 22 nt, Homo sapiens
acaaaguucugugaugcacuga

SEQ ID NO: 1425 - RNA, 22 nt, Homo sapiens
gccugaguguauaacagaacuu

SEQ ID NO: 1426 - RNA, 21 nt, Homo sapiens
gcacagcccccgucccucccu

SEQ ID NO: 1427 - RNA, 23 nt, Homo sapiens
gggagugaagacacggagccaga

SEQ ID NO: 1428 - RNA, 22 nt, Homo sapiens
cugucccccaggccuguaccag

SEQ ID NO: 1429 - RNA, 22 nt, Homo sapiens
cacugguacaaggguugggaga

SEQ ID NO: 1430 - RNA, 21 nt, Homo sapiens
ccucaaggagcuucagucuag

SEQ ID NO: 1431 - RNA, 21 nt, Homo sapiens
acuagacugugagcuccucga

SEQ ID NO: 1432 - RNA, 18 nt, Homo sapiens
agacugugagcuccucga

SEQ ID NO: 1433 - RNA, 21 nt, Homo sapiens
ccaaguucugucaugcacuga

SEQ ID NO: 1434 - RNA, 22 nt, Homo sapiens
gaucacuuuugugacuaugcaa

SEQ ID NO: 1435 - RNA, 22 nt, Homo sapiens
acaacuguaacuagacgguuuu

SEQ ID NO: 1436 - RNA, 23 nt, Homo sapiens
aggaacagcagcagcccgggccg

SEQ ID NO: 1437 - RNA, 21 nt, Homo sapiens
gggcaucugggacgcgcagga

SEQ ID NO: 1438 - RNA, 22 nt, Homo sapiens
aauaggucaaccguguaugauu

SEQ ID NO: 1439 - RNA, 22 nt, Homo sapiens
cgaaggcaacacggauaaccua

SEQ ID NO: 1440 - RNA, 22 nt, Homo sapiens
uguuaaugcuaauauguaggag

SEQ ID NO: 1441 - RNA, 23 nt, Homo sapiens
accccuaucacgauuagcauuaa

SEQ ID NO: 1442 - RNA, 20 nt, Homo sapiens
cccaacccagcccagcccaa

SEQ ID NO: 1443 - RNA, 22 nt, Homo sapiens
ugaggcagcacaauauggccug

SEQ ID NO: 1444 - RNA, 22 nt, Homo sapiens
cacaaaccauuaugugcugcua

SEQ ID NO: 1445 - RNA, 22 nt, Homo sapiens
uagagcagcaaauaaugauucg

SEQ ID NO: 1446 - RNA, 22 nt, Homo sapiens
uguaaaccaugaugugcugcua

SEQ ID NO: 1447 - RNA, 22 nt, Homo sapiens
ucagcagcacaguuaauacugg

SEQ ID NO: 1448 - RNA, 22 nt, Homo sapiens
uaaagcagcacaguaauauugg

SEQ ID NO: 1449 - RNA, 22 nt, Homo sapiens
cgccaauauuuacgugcugcua

SEQ ID NO: 1450 - RNA, 22 nt, Homo sapiens
cuacaagugccuucacugcagu

SEQ ID NO: 1451 - RNA, 23 nt, Homo sapiens
cuaccugcacuguaagcacuuug

SEQ ID NO: 1452 - RNA, 22 nt, Homo sapiens
gguacagucaacggucaguggu

SEQ ID NO: 1453 - RNA, 22 nt, Homo sapiens
gguacaaucaacggucgauggu

SEQ ID NO: 1454 - RNA, 23 nt, Homo sapiens
acucaccgacagcguugaauguu

SEQ ID NO: 1455 - RNA, 21 nt, Homo sapiens
uugcauucauuguucagugag

SEQ ID NO: 1456 - RNA, 23 nt, Homo sapiens
acccaccgacagcaaugaauguu

SEQ ID NO: 1457 - RNA, 22 nt, Homo sapiens
guccacucaacggucgaugguu

SEQ ID NO: 1458 - RNA, 22 nt, Homo sapiens
acucaccgacagguugaauguu

SEQ ID NO: 1459 - RNA, 23 nt, Homo sapiens
acccaccgacaacaaugaauguu

SEQ ID NO: 1460 - RNA, 21 nt, Homo sapiens
uaguuggcaagucuagaacca

SEQ ID NO: 1461 - RNA, 18 nt, Homo sapiens
ggagaggagggcacugga

SEQ ID NO: 1462 - RNA, 24 nt, Homo sapiens
agugugaguucuaccauugccaaa

SEQ ID NO: 1463 - RNA, 18 nt, Homo sapiens
auucaaucuacugccuca

SEQ ID NO: 1464 - RNA, 22 nt, Homo sapiens
uuauggcccuucgguaauucac

SEQ ID NO: 1465 - RNA, 22 nt, Homo sapiens
agugaauucuaccagugccaua

SEQ ID NO: 1466 - RNA, 22 nt, Homo sapiens
acccuuaucaguucuccgucca

SEQ ID NO: 1467 - RNA, 22 nt, Homo sapiens
gaccagaggaaagccagccccu

SEQ ID NO: 1468 - RNA, 22 nt, Homo sapiens
ucaggaacugccuuucucucca

SEQ ID NO: 1469 - RNA, 22 nt, Homo sapiens
cccaaaaaauucaccuuugggc

SEQ ID NO: 1470 - RNA, 22 nt, Homo sapiens
agcccaaaaggagaauucuuug

SEQ ID NO: 1471 - RNA, 22 nt, Homo sapiens
ccggcugcaacacaagacacga

SEQ ID NO: 1472 - RNA, 22 nt, Homo sapiens
gcccggguccuguguuguagcc

SEQ ID NO: 1473 - RNA, 21 nt, Homo sapiens
ugcaaacccugcaugugggag

SEQ ID NO: 1474 - RNA, 21 nt, Homo sapiens
cccuccaccaugcaagggaug

SEQ ID NO: 1475 - RNA, 23 nt, Homo sapiens
ccagaaggagcacuuagggcagu

SEQ ID NO: 1476 - RNA, 23 nt, Homo sapiens
cuaucugcacuagaugcaccuua

SEQ ID NO: 1477 - RNA, 22 nt, Homo sapiens
gccagaaggggcauuuagggca

SEQ ID NO: 1478 - RNA, 23 nt, Homo sapiens
cuaacugcacuagaugcaccuua

SEQ ID NO: 1479 - RNA, 21 nt, Homo sapiens
gaccaaucgccguccccgccg

SEQ ID NO: 1480 - RNA, 22 nt, Homo sapiens
cggugagcacccggccccugcg

SEQ ID NO: 1481 - RNA, 21 nt, Homo sapiens
cagggcaggcaccggcacuca

SEQ ID NO: 1482 - RNA, 22 nt, Homo sapiens
accuaauauaucaaacauauca

SEQ ID NO: 1483 - RNA, 21 nt, Homo sapiens
aacccaauaucaaacauauca

SEQ ID NO: 1484 - RNA, 21 nt, Homo sapiens
aggcggcaggcacaggacugg

SEQ ID NO: 1485 - RNA, 20 nt, Homo sapiens
ggagaccacaaugccuggug

SEQ ID NO: 1486 - RNA, 23 nt, Homo sapiens
cccaacagacauggcgguacuca

SEQ ID NO: 1487 - RNA, 22 nt, Homo sapiens
uucacacugcaugcucugggua

SEQ ID NO: 1488 - RNA, 22 nt, Homo sapiens
uggcagcagcggagggggcaga

SEQ ID NO: 1489 - RNA, 22 nt, Homo sapiens
ggggacgaaauccaagcgcagc

SEQ ID NO: 1490 - RNA, 22 nt, Homo sapiens
ccucccagugcgggaccccucc

SEQ ID NO: 1491 - RNA, 22 nt, Homo sapiens
cagaagugggccgggcacaggg

SEQ ID NO: 1492 - RNA, 20 nt, Homo sapiens
cccgccgcgucgcccugggg

SEQ ID NO: 1493 - RNA, 22 nt, Homo sapiens
ggcccgggcagcaaggcaaggu

SEQ ID NO: 1494 - RNA, 23 nt, Homo sapiens
cagcugcuuuugggauuccguug

SEQ ID NO: 1495 - RNA, 22 nt, Homo sapiens
cugugaccuauggaauuggcag

SEQ ID NO: 1496 - RNA, 21 nt, Homo sapiens
ggcugucaauucauaggucag

SEQ ID NO: 1497 - RNA, 22 nt, Homo sapiens
acugggacuuuguaggccaguu

SEQ ID NO: 1498 - RNA, 22 nt, Homo sapiens
ucaucucgcccgcaaagaccca

SEQ ID NO: 1499 - RNA, 22 nt, Homo sapiens
agcgggacuuugagggccaguu

SEQ ID NO: 1500 - RNA, 22 nt, Homo sapiens
ucaucucgcccucaaaaccccg

SEQ ID NO: 1501 - RNA, 22 nt, Homo sapiens
cagauaacagcagccccacugg

SEQ ID NO: 1502 - RNA, 22 nt, Homo sapiens
uccacauggaguugcuguuaca

SEQ ID NO: 1503 - RNA, 22 nt, Homo sapiens
ggagcagcacagccaauauugg

SEQ ID NO: 1504 - RNA, 21 nt, Homo sapiens
gccaauauuucugugcugcua

SEQ ID NO: 1505 - RNA, 22 nt, Homo sapiens
cucaggcaguuucuuguugccg

SEQ ID NO: 1506 - RNA, 22 nt, Homo sapiens
cccaacaacaugaaacuaccua

SEQ ID NO: 1507 - RNA, 22 nt, Homo sapiens
gaaggcagugucgugcugucga

SEQ ID NO: 1508 - RNA, 22 nt, Homo sapiens
cccaacaacaggaaacuaccua

SEQ ID NO: 1509 - RNA, 22 nt, Homo sapiens
ugagccacugugccuggccuga

SEQ ID NO: 1510 - RNA, 19 nt, Homo sapiens
uaugcuaccuuugcacggu

SEQ ID NO: 1511 - RNA, 22 nt, Homo sapiens
gcuggguggagaagguggugaa

SEQ ID NO: 1512 - RNA, 23 nt, Homo sapiens
ccucccacugcccucucuacccg

SEQ ID NO: 1513 - RNA, 20 nt, Homo sapiens
acagcaaggagggcaggagg

SEQ ID NO: 1514 - RNA, 22 nt, Homo sapiens
gaaccuaucuccccucuggacc

SEQ ID NO: 1515 - RNA, 22 nt, Homo sapiens
uaaccaaugugcagacuacugu

SEQ ID NO: 1516 - RNA, 23 nt, Homo sapiens
gaacagguagucugaacacuggg

SEQ ID NO: 1517 - RNA, 22 nt, Homo sapiens
uaaccaaugugcagacuacugu

SEQ ID NO: 1518 - RNA, 23 nt, Homo sapiens
gaacagauagucuaaacacuggg

SEQ ID NO: 1519 - RNA, 23 nt, Homo sapiens
ucaguuuugcauagauuugcaca

SEQ ID NO: 1520 - RNA, 22 nt, Homo sapiens
uguagugcaacuaugcaaaacu

SEQ ID NO: 1521 - RNA, 23 nt, Homo sapiens
gcuggaugcaaaccugcaaaacu

SEQ ID NO: 1522 - RNA, 22 nt, Homo sapiens
ugaaaugcaaaccugcaaaacu

SEQ ID NO: 1523 - RNA, 23 nt, Homo sapiens
ucaguuuugcauggauuugcaca

SEQ ID NO: 1524 - RNA, 22 nt, Homo sapiens
acaucguuaccagacaguguua

SEQ ID NO: 1525 - RNA, 22 nt, Homo sapiens
uccagcacuguccgguaagaug

SEQ ID NO: 1526 - RNA, 22 nt, Homo sapiens
ucaucauuaccaggcaguauua

SEQ ID NO: 1527 - RNA, 22 nt, Homo sapiens
uccaaugcugcccaguaagaug

SEQ ID NO: 1528 - RNA, 23 nt, Homo sapiens
uccaucauuacccggcaguauua

SEQ ID NO: 1529 - RNA, 22 nt, Homo sapiens
ccaaacacugcuggguaagacg

SEQ ID NO: 1530 - RNA, 20 nt, Homo sapiens
uucccaugcccuauaccucu

SEQ ID NO: 1531 - RNA, 22 nt, Homo sapiens
caaagaaguauaugcauaggaa

SEQ ID NO: 1532 - RNA, 22 nt, Homo sapiens
cuagugguccuaaacauuucac

SEQ ID NO: 1533 - RNA, 23 nt, Homo sapiens
uccagugguucuuaacaguucaa

SEQ ID NO: 1534 - RNA, 22 nt, Homo sapiens
ugugaaauguuuaggaccacua

SEQ ID NO: 1535 - RNA, 21 nt, Homo sapiens
acgucccuuugccuucccagc

SEQ ID NO: 1536 - RNA, 22 nt, Homo sapiens
aggcauaggaugacaaagggaa

SEQ ID NO: 1537 - RNA, 20 nt, Homo sapiens
acauuacuguuaucaaaaca

SEQ ID NO: 1538 - RNA, 23 nt, Homo sapiens
guaaauagagguuuaauuaacac

SEQ ID NO: 1539 - RNA, 21 nt, Homo sapiens
gaacuucacuccacugaaauc

SEQ ID NO: 1540 - RNA, 23 nt, Homo sapiens
aauaaauuaaauuuauauuacag

SEQ ID NO: 1541 - RNA, 22 nt, Homo sapiens
cagacuccgguggaaugaagga

SEQ ID NO: 1542 - RNA, 22 nt, Homo sapiens
ccacacacuuccuuacauucca

SEQ ID NO: 1543 - RNA, 22 nt, Homo sapiens
acaagcuuuuugcucgucuuau

SEQ ID NO: 1544 - RNA, 22 nt, Homo sapiens
acaaaccuuuuguucgucuuau

SEQ ID NO: 1545 - RNA, 22 nt, Homo sapiens
cuuuaagugcucauaaugcagu

SEQ ID NO: 1546 - RNA, 23 nt, Homo sapiens
cuaccugcacuauaagcacuuua

SEQ ID NO: 1547 - RNA, 22 nt, Homo sapiens
cuggaagugcccauacuacagu

SEQ ID NO: 1548 - RNA, 23 nt, Homo sapiens
cuaccugcacuaugagcacuuug

SEQ ID NO: 1549 - RNA, 22 nt, Homo sapiens
ucagccgcugucacacgcacag

SEQ ID NO: 1550 - RNA, 22 nt, Homo sapiens
cacucagcggccguuuccccaa

SEQ ID NO: 1551 - RNA, 21 nt, Homo sapiens
gugacagagccaagcacaaau

SEQ ID NO: 1552 - RNA, 21 nt, Homo sapiens
gcaccccuuugcugucccugc

SEQ ID NO: 1553 - RNA, 21 nt, Homo sapiens
aagucccuugcuugaggcucg

SEQ ID NO: 1554 - RNA, 22 nt, Homo sapiens
gaccgcuucaaggaagggacua

SEQ ID NO: 1555 - RNA, 22 nt, Homo sapiens
cuagccuccaugaauucugaug

SEQ ID NO: 1556 - RNA, 22 nt, Homo sapiens
uccaucaggagucauggaagcu

SEQ ID NO: 1557 - RNA, 22 nt, Homo sapiens
aggcgaaggaugacaaagggaa

SEQ ID NO: 1558 - RNA, 21 nt, Homo sapiens
gggaguucuuggcaugggagg

SEQ ID NO: 1559 - RNA, 21 nt, Homo sapiens
agaccuccuaugcuaagaacc

SEQ ID NO: 1560 - RNA, 21 nt, Homo sapiens
cuguccuuggcaaagagaaca

SEQ ID NO: 1561 - RNA, 21 nt, Homo sapiens
ggccgugacuggagacuguua

SEQ ID NO: 1562 - RNA, 23 nt, Homo sapiens
aguaagcagucuagagccaaggu

SEQ ID NO: 1563 - RNA, 21 nt, Homo sapiens
acagcccaucgacugguguug

SEQ ID NO: 1564 - RNA, 22 nt, Homo sapiens
acugccugucugugccugcugu

SEQ ID NO: 1565 - RNA, 22 nt, Homo sapiens
gcacagcaaguguagacaggca

SEQ ID NO: 1566 - RNA, 21 nt, Homo sapiens
gucugucaauucauaggucau

SEQ ID NO: 1567 - RNA, 22 nt, Homo sapiens
ucaacaucagucugauaagcua

SEQ ID NO: 1568 - RNA, 22 nt, Homo sapiens
auaaucccagagaccacuguga

SEQ ID NO: 1569 - RNA, 22 nt, Homo sapiens
ucacaguugccagcugagauua

SEQ ID NO: 1570 - RNA, 22 nt, Homo sapiens
ucacauuugccugcagagauuu

SEQ ID NO: 1571 - RNA, 23 nt, Homo sapiens
uccaaucaguuccugaugcagua

SEQ ID NO: 1572 - RNA, 22 nt, Homo sapiens
ccauggugcuugacggaaccau

SEQ ID NO: 1573 - RNA, 22 nt, Homo sapiens
cgcggugcuugacagaaccaug

SEQ ID NO: 1574 - RNA, 21 nt, Homo sapiens
acaugguuagaucaagcacaa

SEQ ID NO: 1575 - RNA, 22 nt, Homo sapiens
cgggacguccagacucaacucu

SEQ ID NO: 1576 - RNA, 22 nt, Homo sapiens
acagauguccagccacaauucu

SEQ ID NO: 1577 - RNA, 21 nt, Homo sapiens
agaauugcguuuggacaauca

SEQ ID NO: 1578 - RNA, 23 nt, Homo sapiens
gaaacccagcagacaauguagcu

SEQ ID NO: 1579 - RNA, 22 nt, Homo sapiens
aaaucuacauuguaugccaggu

SEQ ID NO: 1580 - RNA, 21 nt, Homo sapiens
acccaguagccagauguagcu

SEQ ID NO: 1581 - RNA, 22 nt, Homo sapiens
aggaucuacacuggcuacugag

SEQ ID NO: 1582 - RNA, 22 nt, Homo sapiens
ugggguauuugacaaacugaca

SEQ ID NO: 1583 - RNA, 22 nt, Homo sapiens
aacucagcuugucaaauacacg

SEQ ID NO: 1584 - RNA, 22 nt, Homo sapiens
acaguucuucaacuggcagcuu

SEQ ID NO: 1585 - RNA, 23 nt, Homo sapiens
uguagucacuagggcaccauuuu

SEQ ID NO: 1586 - RNA, 21 nt, Homo sapiens
aacggaaccacuagugacuug

SEQ ID NO: 1587 - RNA, 22 nt, Homo sapiens
uaaagcuugccacugaagaacu

SEQ ID NO: 1588 - RNA, 22 nt, Homo sapiens
ccucgccucugacacuugcaga

SEQ ID NO: 1589 - RNA, 21 nt, Homo sapiens
gagccaggcagggcgcuguca

SEQ ID NO: 1590 - RNA, 24 nt, Homo sapiens
gacuggcagcgcucagcccgcgcu

SEQ ID NO: 1591 - RNA, 22 nt, Homo sapiens
ccaggcaacacacacugcucuc

SEQ ID NO: 1592 - RNA, 22 nt, Homo sapiens
aucuccaaacagcaaggacaau

SEQ ID NO: 1593 - RNA, 21 nt, Homo sapiens
uuguccauuguaucuggggau

SEQ ID NO: 1594 - RNA, 20 nt, Homo sapiens
caccucucacccccauccua

SEQ ID NO: 1595 - RNA, 21 nt, Homo sapiens
ggaaaucccuggcaaugugau

SEQ ID NO: 1596 - RNA, 22 nt, Homo sapiens
aaaucccauccccaggaacccc

SEQ ID NO: 1597 - RNA, 21 nt, Homo sapiens
gguaaucccuggcaaugugau

SEQ ID NO: 1598 - RNA, 22 nt, Homo sapiens
aaaucagcaugccaggaaccca

SEQ ID NO: 1599 - RNA, 22 nt, Homo sapiens
ggguaaucacuggcaaugugau

SEQ ID NO: 1600 - RNA, 22 nt, Homo sapiens
acugauaucagcucaguaggca

SEQ ID NO: 1601 - RNA, 22 nt, Homo sapiens
cuguguuucagcucaguaggca

SEQ ID NO: 1602 - RNA, 22 nt, Homo sapiens
cuguuccugcugaacugagcca

SEQ ID NO: 1603 - RNA, 22 nt, Homo sapiens
ccugagccucucugccucugcu

SEQ ID NO: 1604 - RNA, 23 nt, Homo sapiens
gagccaaggcuaacagagccuca

SEQ ID NO: 1605 - RNA, 22 nt, Homo sapiens
ucagaccgagacaagugcaaug

SEQ ID NO: 1606 - RNA, 21 nt, Homo sapiens
caauugcccaagucuccgccu

SEQ ID NO: 1607 - RNA, 22 nt, Homo sapiens
gugcuuuaccaacuccaugaua

SEQ ID NO: 1608 - RNA, 22 nt, Homo sapiens
agucuccuggaggugguaaaac

SEQ ID NO: 1609 - RNA, 22 nt, Homo sapiens
ggaagacagcgcugaagaggcg

SEQ ID NO: 1610 - RNA, 23 nt, Homo sapiens
gacgucugaacagucacugccug

SEQ ID NO: 1611 - RNA, 22 nt, Homo sapiens
cgugcaaguaaccaagaauagg

SEQ ID NO: 1612 - RNA, 22 nt, Homo sapiens
gaaacaaguaaucaagaauagg

SEQ ID NO: 1613 - RNA, 22 nt, Homo sapiens
agccuauccuggauuacuugaa

SEQ ID NO: 1614 - RNA, 22 nt, Homo sapiens
gagccaaguaauggagaacagg

SEQ ID NO: 1615 - RNA, 21 nt, Homo sapiens
accuauccugaauuacuugaa

SEQ ID NO: 1616 - RNA, 21 nt, Homo sapiens
gcggaacuuagccacugugaa

SEQ ID NO: 1617 - RNA, 22 nt, Homo sapiens
ugcucacaagcagcuaagcccu

SEQ ID NO: 1618 - RNA, 21 nt, Homo sapiens
gcagaacuuagccacugugaa

SEQ ID NO: 1619 - RNA, 22 nt, Homo sapiens
guucaccaaucagcuaagcucu

SEQ ID NO: 1620 - RNA, 22 nt, Homo sapiens
uccaggagcucacaaucuagug

SEQ ID NO: 1621 - RNA, 22 nt, Homo sapiens
cucaauagacugugagcuccuu

SEQ ID NO: 1622 - RNA, 19 nt, Homo sapiens
ccgcccaccgccaggcccc

SEQ ID NO: 1623 - RNA, 21 nt, Homo sapiens
ccaagagauguuggcccuaac

SEQ ID NO: 1624 - RNA, 22 nt, Homo sapiens
ggagagccuccacccaacccuc

SEQ ID NO: 1625 - RNA, 23 nt, Homo sapiens
acugauuguccaaacgcaauucu

SEQ ID NO: 1626 - RNA, 22 nt, Homo sapiens
cgagaauuguggcuggacaucu

SEQ ID NO: 1627 - RNA, 21 nt, Homo sapiens
acaggauugagggggggcccu

SEQ ID NO: 1628 - RNA, 21 nt, Homo sapiens
caugcacaugcacacauacau

SEQ ID NO: 1629 - RNA, 24 nt, Homo sapiens
ugggagaaccucccugcuucugcu

SEQ ID NO: 1630 - RNA, 22 nt, Homo sapiens
aagcgguuuaccaucccacaua

SEQ ID NO: 1631 - RNA, 22 nt, Homo sapiens
auguaugugggacgguaaacca

SEQ ID NO: 1632 - RNA, 22 nt, Homo sapiens
uaaccgauuucagauggugcua

SEQ ID NO: 1633 - RNA, 22 nt, Homo sapiens
cugaacaccaaaagaaaucagu

SEQ ID NO: 1634 - RNA, 24 nt, Homo sapiens
ucuaaaccaccauaugaaaccagc

SEQ ID NO: 1635 - RNA, 22 nt, Homo sapiens
cuaagccaccaugugaaaccag

SEQ ID NO: 1636 - RNA, 23 nt, Homo sapiens
aacacugauuucaaauggugcua

SEQ ID NO: 1637 - RNA, 22 nt, Homo sapiens
uaaccgauuucaaauggugcua

SEQ ID NO: 1638 - RNA, 22 nt, Homo sapiens
gaacaccaggagaaaucgguca

SEQ ID NO: 1639 - RNA, 22 nt, Homo sapiens
agagagagucugcccuuguaua

SEQ ID NO: 1640 - RNA, 23 nt, Homo sapiens
gcuuugacaauacuauugcacug

SEQ ID NO: 1641 - RNA, 22 nt, Homo sapiens
aguagugcaauaaagucagagc

SEQ ID NO: 1642 - RNA, 23 nt, Homo sapiens
gcuuugacaauaucauugcacug

SEQ ID NO: 1643 - RNA, 23 nt, Homo sapiens
ucaccaaaacauggaagcacuua

SEQ ID NO: 1644 - RNA, 23 nt, Homo sapiens
agcaaguacauccacguuuaagu

SEQ ID NO: 1645 - RNA, 23 nt, Homo sapiens
cuacuaaaacauggaagcacuua

SEQ ID NO: 1646 - RNA, 22 nt, Homo sapiens
gaaagcacuuccauguuaaagu

SEQ ID NO: 1647 - RNA, 23 nt, Homo sapiens
ccacugaaacauggaagcacuua

SEQ ID NO: 1648 - RNA, 22 nt, Homo sapiens
cagcagguacccccauguuaaa

SEQ ID NO: 1649 - RNA, 23 nt, Homo sapiens
acacucaaacauggaagcacuua

SEQ ID NO: 1650 - RNA, 22 nt, Homo sapiens
gcaagugccuccauguuaaagu

SEQ ID NO: 1651 - RNA, 17 nt, Homo sapiens
aagcauggaagcacuua

SEQ ID NO: 1652 - RNA, 17 nt, Homo sapiens
aaacauggaagcaauua

SEQ ID NO: 1653 - RNA, 23 nt, Homo sapiens
uguaagguguugcaguguggcaa

SEQ ID NO: 1654 - RNA, 21 nt, Homo sapiens
uugcacaccacaacagccaga

SEQ ID NO: 1655 - RNA, 23 nt, Homo sapiens
cuccaacaauauccuggugcuga

SEQ ID NO: 1656 - RNA, 23 nt, Homo sapiens
uccagcaucagugauuuuguuga

SEQ ID NO: 1657 - RNA, 22 nt, Homo sapiens
cggugccuacugagcugauauc

SEQ ID NO: 1658 - RNA, 21 nt, Homo sapiens
cuggcucaguucagcaggaac

SEQ ID NO: 1659 - RNA, 22 nt, Homo sapiens
gcugcaaacauccgacugaaag

SEQ ID NO: 1660 - RNA, 22 nt, Homo sapiens
cuuccagucgaggauguuuaca

SEQ ID NO: 1661 - RNA, 22 nt, Homo sapiens
gaaguaaacauccaccucccag

SEQ ID NO: 1662 - RNA, 22 nt, Homo sapiens
agcugaguguaggauguuuaca

SEQ ID NO: 1663 - RNA, 22 nt, Homo sapiens
ggaguaaacaacccucucccag

SEQ ID NO: 1664 - RNA, 22 nt, Homo sapiens
agaguaaacagccuucucccag

SEQ ID NO: 1665 - RNA, 23 nt, Homo sapiens
gcugagaguguaggauguuuaca

SEQ ID NO: 1666 - RNA, 22 nt, Homo sapiens
gcagcaaacaucugacugaaag

SEQ ID NO: 1667 - RNA, 22 nt, Homo sapiens
cuuccagucggggauguuuaca

SEQ ID NO: 1668 - RNA, 22 nt, Homo sapiens
gcuguaaacauccgacugaaag

SEQ ID NO: 1669 - RNA, 22 nt, Homo sapiens
cuuccagucaaggauguuuaca

SEQ ID NO: 1670 - RNA, 20 nt, Homo sapiens
accaacuaguaaacccauau

SEQ ID NO: 1671 - RNA, 22 nt, Homo sapiens
agucccuacuauguuccaggca

SEQ ID NO: 1672 - RNA, 21 nt, Homo sapiens
cuggcacuauaugaguccuau

SEQ ID NO: 1673 - RNA, 20 nt, Homo sapiens
auaugacucguauagugucu

SEQ ID NO: 1674 - RNA, 23 nt, Homo sapiens
agaauuuucauaaugcagucaca

SEQ ID NO: 1675 - RNA, 20 nt, Homo sapiens
gccaucaaaguuaaaagcca

SEQ ID NO: 1676 - RNA, 21 nt, Homo sapiens
ugccugucuacacuugcugug

SEQ ID NO: 1677 - RNA, 21 nt, Homo sapiens
uguacagcaggcacagacagg

SEQ ID NO: 1678 - RNA, 22 nt, Homo sapiens
uguccuuugccuacucuauuua

SEQ ID NO: 1679 - RNA, 22 nt, Homo sapiens
cuuaaauagaauaggcaaagga

SEQ ID NO: 1680 - RNA, 22 nt, Homo sapiens
aagaccguccucuugucccaac

SEQ ID NO: 1681 - RNA, 17 nt, Homo sapiens
gauuaaacaauucucug

SEQ ID NO: 1682 - RNA, 22 nt, Homo sapiens
acuucacgggagugaggaaagu

SEQ ID NO: 1683 - RNA, 21 nt, Homo sapiens
gacuuugccuucgcccgcgaa

SEQ ID NO: 1684 - RNA, 20 nt, Homo sapiens
ucucuccacagcuuccucua

SEQ ID NO: 1685 - RNA, 22 nt, Homo sapiens
ucugugugacggaugccagaug

SEQ ID NO: 1686 - RNA, 22 nt, Homo sapiens
ugcuucuggcaucugucccuca

SEQ ID NO: 1687 - RNA, 22 nt, Homo sapiens
ccagcaggccugcagaagggga

SEQ ID NO: 1688 - RNA, 23 nt, Homo sapiens
cuucccauuccacaagcccugau

SEQ ID NO: 1689 - RNA, 23 nt, Homo sapiens
augagaguuuuuuacuugccaga

SEQ ID NO: 1690 - RNA, 22 nt, Homo sapiens
gcagcaguguagagauuaguuu

SEQ ID NO: 1691 - RNA, 22 nt, Homo sapiens
aaaccaaucucuacacuacugc

SEQ ID NO: 1692 - RNA, 21 nt, Homo sapiens
uuacccagucuccggugcagc

SEQ ID NO: 1693 - RNA, 21 nt, Homo sapiens
ggcugcaccggagacugggua

SEQ ID NO: 1694 - RNA, 23 nt, Homo sapiens
aaggcccuuccaccaguccucga

SEQ ID NO: 1695 - RNA, 24 nt, Homo sapiens
uccucugagcuccuucucuaccca

SEQ ID NO: 1696 - RNA, 22 nt, Homo sapiens
auuggguuuuaagaguucuuua

SEQ ID NO: 1697 - RNA, 23 nt, Homo sapiens
aauauguagucuuuuauccauca

SEQ ID NO: 1698 - RNA, 22 nt, Homo sapiens
cacugcagucucagccuaggca

SEQ ID NO: 1699 - RNA, 22 nt, Homo sapiens
caccacugcacucgcuccagcc

SEQ ID NO: 1700 - RNA, 22 nt, Homo sapiens
acuaacugaauagguugggcca

SEQ ID NO: 1701 - RNA, 23 nt, Homo sapiens
aaugacccuaccuauucagucag

SEQ ID NO: 1702 - RNA, 24 nt, Homo sapiens
accccauugcucccaggcuacaga

SEQ ID NO: 1703 - RNA, 24 nt, Homo sapiens
acucccucuaccucacuguccaca

SEQ ID NO: 1704 - RNA, 23 nt, Homo sapiens
aacaggcaucuguugagcuccua

SEQ ID NO: 1705 - RNA, 22 nt, Homo sapiens
auggcaauauguuggcauagca

SEQ ID NO: 1706 - RNA, 22 nt, Homo sapiens
acuaccugaauucccaaaagcu

SEQ ID NO: 1707 - RNA, 21 nt, Homo sapiens
aaagcuuuugguaauucaggu

SEQ ID NO: 1708 - RNA, 19 nt, Homo sapiens
uccuccuccacccgcccuc

SEQ ID NO: 1709 - RNA, 22 nt, Homo sapiens
ucugaagguucagaaaggccuu

SEQ ID NO: 1710 - RNA, 25 nt, Homo sapiens
cgaaagaagcgcuuuacaauguuau

SEQ ID NO: 1711 - RNA, 22 nt, Homo sapiens
uaaagagaccgaacagguauau

SEQ ID NO: 1712 - RNA, 22 nt, Homo sapiens
cuauauaucucuuugguccccu

SEQ ID NO: 1713 - RNA, 24 nt, Homo sapiens
caauuccaaacacucaaaauaucu

SEQ ID NO: 1714 - RNA, 22 nt, Homo sapiens
ugaguuuugaguguuuggaguu

SEQ ID NO: 1715 - RNA, 22 nt, Homo sapiens
ccauucuuucuauccuagcaug

SEQ ID NO: 1716 - RNA, 24 nt, Homo sapiens
ucacacccuccucacugcccaacc

SEQ ID NO: 1717 - RNA, 22 nt, Homo sapiens
aagcacacaccaguuuuuucca

SEQ ID NO: 1718 - RNA, 23 nt, Homo sapiens
auacacacacauauccauacaaa

SEQ ID NO: 1719 - RNA, 22 nt, Homo sapiens
ccaaccucgaggaucuccccag

SEQ ID NO: 1720 - RNA, 22 nt, Homo sapiens
gcugaggagaucgucgagguug

SEQ ID NO: 1721 - RNA, 21 nt, Homo sapiens
ccaaccucgacgaucuccuca

SEQ ID NO: 1722 - RNA, 22 nt, Homo sapiens
gcuggggagauccucgagguug

SEQ ID NO: 1723 - RNA, 21 nt, Homo sapiens
accugaucccauugccccacc

SEQ ID NO: 1724 - RNA, 22 nt, Homo sapiens
uuauugccccuauucuaacaca

SEQ ID NO: 1725 - RNA, 22 nt, Homo sapiens
cuuguguuagaacagaggcaau

SEQ ID NO: 1726 - RNA, 23 nt, Homo sapiens
aaaugucccuacucgcuuucccc

SEQ ID NO: 1727 - RNA, 22 nt, Homo sapiens
ucugcucccaacuccccuucug

SEQ ID NO: 1728 - RNA, 21 nt, Homo sapiens
aguucccacugcagagccugg

SEQ ID NO: 1729 - RNA, 18 nt, Homo sapiens
ucccacugcagagccugg

SEQ ID NO: 1730 - RNA, 21 nt, Homo sapiens
agaaagaucuggaagugggag

SEQ ID NO: 1731 - RNA, 22 nt, Homo sapiens
ugucucccacuuccagaucuuu

SEQ ID NO: 1732 - RNA, 22 nt, Homo sapiens
agcuucagcuagacuagggcag

SEQ ID NO: 1733 - RNA, 22 nt, Homo sapiens
agacugcacuagccuggcugaa

SEQ ID NO: 1734 - RNA, 22 nt, Homo sapiens
guccugcagagaggaagcccuu

SEQ ID NO: 1735 - RNA, 21 nt, Homo sapiens
gaagggcuuccucucugcagg

SEQ ID NO: 1736 - RNA, 22 nt, Homo sapiens
guggccgacacuuguaauccua

SEQ ID NO: 1737 - RNA, 21 nt, Homo sapiens
agcuaugccagcaucuugccu

SEQ ID NO: 1738 - RNA, 22 nt, Homo sapiens
ugggcuuucuagucucagcucu

SEQ ID NO: 1739 - RNA, 22 nt, Homo sapiens
ggagagcugagacuagaaagcc

SEQ ID NO: 1740 - RNA, 23 nt, Homo sapiens
aucugggccucuguucuuaucag

SEQ ID NO: 1741 - RNA, 21 nt, Homo sapiens
uggggaguggagggguaggga

SEQ ID NO: 1742 - RNA, 23 nt, Homo sapiens
cuccccacccuucuacucccuaa

SEQ ID NO: 1743 - RNA, 22 nt, Homo sapiens
gucuuacugcccucauuuuaua

SEQ ID NO: 1744 - RNA, 22 nt, Homo sapiens
cgccauuucccuuaaagucaca

SEQ ID NO: 1745 - RNA, 22 nt, Homo sapiens
ugaggucacauugcauccaccu

SEQ ID NO: 1746 - RNA, 23 nt, Homo sapiens
uaggccaguaggcauugucugcg

SEQ ID NO: 1747 - RNA, 22 nt, Homo sapiens
acaccaguauuucugaaauccu

SEQ ID NO: 1748 - RNA, 17 nt, Homo sapiens
gucugacuguagaacuc

SEQ ID NO: 1749 - RNA, 22 nt, Homo sapiens
cuaugugccaagcacaguccua

SEQ ID NO: 1750 - RNA, 22 nt, Homo sapiens
acugucugucucagaaccccag

SEQ ID NO: 1751 - RNA, 24 nt, Homo sapiens
gauauauacagauuccauacaucu

SEQ ID NO: 1752 - RNA, 22 nt, Homo sapiens
uggccugccuauuuccuccuuu

SEQ ID NO: 1753 - RNA, 22 nt, Homo sapiens
aaaggagaaaacaggcagggca

SEQ ID NO: 1754 - RNA, 23 nt, Homo sapiens
ggcucugcaucucuaacucacua

SEQ ID NO: 1755 - RNA, 22 nt, Homo sapiens
acgucacugcguucucuccccg

SEQ ID NO: 1756 - RNA, 19 nt, Homo sapiens
ccgguagucccaggccagu

SEQ ID NO: 1757 - RNA, 21 nt, Homo sapiens
acguguccccagugccgugca

SEQ ID NO: 1758 - RNA, 23 nt, Homo sapiens
agcgccuggcacguguguacaca

SEQ ID NO: 1759 - RNA, 17 nt, Homo sapiens
cgauccggccgcgcccc

SEQ ID NO: 1760 - RNA, 22 nt, Homo sapiens
acguuuaaauuucaccccuucu

SEQ ID NO: 1761 - RNA, 19 nt, Homo sapiens
cuccggaagcuccgcccca

SEQ ID NO: 1762 - RNA, 22 nt, Homo sapiens
ggccuccggaagcuccgcccca

SEQ ID NO: 1763 - RNA, 25 nt, Homo sapiens
cgacguggggcggagcgucuggaag

SEQ ID NO: 1764 - RNA, 19 nt, Homo sapiens
ccggcgccgagggcccgau

SEQ ID NO: 1765 - RNA, 17 nt, Homo sapiens
gacuacacuacagaagc

SEQ ID NO: 1766 - RNA, 22 nt, Homo sapiens
uccgagcgacuccgagagaggc

SEQ ID NO: 1767 - RNA, 23 nt, Homo sapiens
ugaggggcagagagcgagacuuu

SEQ ID NO: 1768 - RNA, 24 nt, Homo sapiens
aaaagcucggucugaggccccuca

SEQ ID NO: 1769 - RNA, 23 nt, Homo sapiens
ccgcagaccgaccgccuucuucu

SEQ ID NO: 1770 - RNA, 21 nt, Homo sapiens
caaagccaucucuccgcguga

SEQ ID NO: 1771 - RNA, 22 nt, Homo sapiens
aagccacguagacagacgccug

SEQ ID NO: 1772 - RNA, 20 nt, Homo sapiens
ccgcgcagccccauggccaa

SEQ ID NO: 1773 - RNA, 23 nt, Homo sapiens
ccuucagccacacgcugcccagg

SEQ ID NO: 1774 - RNA, 23 nt, Homo sapiens
ccccguauccgcacaaagccucu

SEQ ID NO: 1775 - RNA, 21 nt, Homo sapiens
cuaccccaucagacccaaggg

SEQ ID NO: 1776 - RNA, 25 nt, Homo sapiens
uccuacccagggcacagauggggca

SEQ ID NO: 1777 - RNA, 23 nt, Homo sapiens
ucucuggccgucuaccuuccaca

SEQ ID NO: 1778 - RNA, 20 nt, Homo sapiens
uggggacguagcuggccaga

SEQ ID NO: 1779 - RNA, 23 nt, Homo sapiens
cugucuggccagcuacgucccca

SEQ ID NO: 1780 - RNA, 22 nt, Homo sapiens
uggaagguagacggccagagag

SEQ ID NO: 1781 - RNA, 23 nt, Homo sapiens
uuccacugcuacaaccucccaga

SEQ ID NO: 1782 - RNA, 22 nt, Homo sapiens
acuccucagauccuacgcagga

SEQ ID NO: 1783 - RNA, 22 nt, Homo sapiens
acugccagugagcagcagagcu

SEQ ID NO: 1784 - RNA, 21 nt, Homo sapiens
cagcccuccugguggcuggcc

SEQ ID NO: 1785 - RNA, 17 nt, Homo sapiens
aacccgggcccggcgcg

SEQ ID NO: 1786 - RNA, 18 nt, Homo sapiens
gaggccccugccgccccg

SEQ ID NO: 1787 - RNA, 23 nt, Homo sapiens
cgccuuuccgagccugcgccucc

SEQ ID NO: 1788 - RNA, 22 nt, Homo sapiens
ucuccauuccccaggacuccac

SEQ ID NO: 1789 - RNA, 23 nt, Homo sapiens
aacuuucuccuaaggcagucccu

SEQ ID NO: 1790 - RNA, 22 nt, Homo sapiens
cagaccugaguagcgcaaggug

SEQ ID NO: 1791 - RNA, 22 nt, Homo sapiens
accuugugcgccuucucagauu

SEQ ID NO: 1792 - RNA, 17 nt, Homo sapiens
auuuuucuucauauccc

SEQ ID NO: 1793 - RNA, 22 nt, Homo sapiens
auuaaagcucuucucccuucca

SEQ ID NO: 1794 - RNA, 22 nt, Homo sapiens
ucgcccucucaacccagcuuuu

SEQ ID NO: 1795 - RNA, 22 nt, Homo sapiens
uugcccucucaacccagcuuuu

SEQ ID NO: 1796 - RNA, 20 nt, Homo sapiens
acccucucaacccagcuuuu

SEQ ID NO: 1797 - RNA, 19 nt, Homo sapiens
uccucucaacccagcuuuu

SEQ ID NO: 1798 - RNA, 18 nt, Homo sapiens
ccuucucaacccagcuuu

SEQ ID NO: 1799 - RNA, 21 nt, Homo sapiens
agaggucgaccguguaaugug

SEQ ID NO: 1800 - RNA, 22 nt, Homo sapiens
gcgaacgcgccacggaccaccu

SEQ ID NO: 1801 - RNA, 22 nt, Homo sapiens
aagaggucgaccguguauuggg

SEQ ID NO: 1802 - RNA, 23 nt, Homo sapiens
ugcgaacucaccacggacaaccu

SEQ ID NO: 1803 - RNA, 22 nt, Homo sapiens
aaauaucacacacacuaaauug

SEQ ID NO: 1804 - RNA, 20 nt, Homo sapiens
ccagcagcaccuggggcagu

SEQ ID NO: 1805 - RNA, 23 nt, Homo sapiens
acaccaaugcccuaggggaugcg

SEQ ID NO: 1806 - RNA, 23 nt, Homo sapiens
acacuuacuggacaccuacuagg

SEQ ID NO: 1807 - RNA, 22 nt, Homo sapiens
ugcaacuuaguaaugugcaaua

SEQ ID NO: 1808 - RNA, 20 nt, Homo sapiens
cuggaggaagggcccagagg

SEQ ID NO: 1809 - RNA, 22 nt, Homo sapiens
acggaagggcagagagggccag

SEQ ID NO: 1810 - RNA, 22 nt, Homo sapiens
aaagagguuaaccagguguguu

SEQ ID NO: 1811 - RNA, 23 nt, Homo sapiens
ucucugcaggccgugugcuuugc

SEQ ID NO: 1812 - RNA, 22 nt, Homo sapiens
gccuaagacacaggcccagaga

SEQ ID NO: 1813 - RNA, 21 nt, Homo sapiens
uucuaggauaggcccaggggc

SEQ ID NO: 1814 - RNA, 22 nt, Homo sapiens
ggaucccugggaccauaccuag

SEQ ID NO: 1815 - RNA, 22 nt, Homo sapiens
ggucaggagcaauaaugaaaaa

SEQ ID NO: 1816 - RNA, 23 nt, Homo sapiens
acauuuuucguuauugcucuuga

SEQ ID NO: 1817 - RNA, 22 nt, Homo sapiens
gaagaaaggcaucauauaggag

SEQ ID NO: 1818 - RNA, 21 nt, Homo sapiens
aacuccuguaugaagccguuc

SEQ ID NO: 1819 - RNA, 22 nt, Homo sapiens
caacaaaaucacugaugcugga

SEQ ID NO: 1820 - RNA, 22 nt, Homo sapiens
cacucagcaccaggauauuguu

SEQ ID NO: 1821 - RNA, 23 nt, Homo sapiens
cggcucugucgucgaggcgcuca

SEQ ID NO: 1822 - RNA, 23 nt, Homo sapiens
cgugagcuccuggaggacaggga

SEQ ID NO: 1823 - RNA, 22 nt, Homo sapiens
gugaugcacuguggaaacauug

SEQ ID NO: 1824 - RNA, 21 nt, Homo sapiens
ugcaaugcaacuacaaugcac

SEQ ID NO: 1825 - RNA, 22 nt, Homo sapiens
gggcugcacugccgaggcacug

SEQ ID NO: 1826 - RNA, 20 nt, Homo sapiens
gcaaugcaacagcaaugcac

SEQ ID NO: 1827 - RNA, 22 nt, Homo sapiens
gcuauaaaguaacugagacgga

SEQ ID NO: 1828 - RNA, 22 nt, Homo sapiens
aaucagucucauugcuuuauaa

SEQ ID NO: 1829 - RNA, 23 nt, Homo sapiens
acgggugcgauuucugugugaga

SEQ ID NO: 1830 - RNA, 21 nt, Homo sapiens
ucaaucacagauagcaccccu

SEQ ID NO: 1831 - RNA, 22 nt, Homo sapiens
cuccagaccccucguucagggc

SEQ ID NO: 1832 - RNA, 22 nt, Homo sapiens
gagcccuggacuaggagucagc

SEQ ID NO: 1833 - RNA, 23 nt, Homo sapiens
agaggcaggcaugcgggcagaca

SEQ ID NO: 1834 - RNA, 22 nt, Homo sapiens
agggcaguauacuugcugauug

SEQ ID NO: 1835 - RNA, 22 nt, Homo sapiens
acaaccagcuaagacacugcca

SEQ ID NO: 1836 - RNA, 22 nt, Homo sapiens
auggcaguggaguuagugauug

SEQ ID NO: 1837 - RNA, 23 nt, Homo sapiens
caaucagcuaaugacacugccua

SEQ ID NO: 1838 - RNA, 22 nt, Homo sapiens
ccuggccgugugguuagugauu

SEQ ID NO: 1839 - RNA, 23 nt, Homo sapiens
gcaaucagcuaacuacacugccu

SEQ ID NO: 1840 - RNA, 24 nt, Homo sapiens
uggaagacuagugauuuuguuguu

SEQ ID NO: 1841 - RNA, 22 nt, Homo sapiens
aacaacaaaucccagucuaccu

SEQ ID NO: 1842 - RNA, 22 nt, Homo sapiens
guggagugugacaaugguguuu

SEQ ID NO: 1843 - RNA, 23 nt, Homo sapiens
ucaaacgccauuaucacacuaaa

SEQ ID NO: 1844 - RNA, 23 nt, Homo sapiens
cuagaggacagguaacacggagg

SEQ ID NO: 1845 - RNA, 23 nt, Homo sapiens
ggcuuccuugcuauccauccuca

SEQ ID NO: 1846 - RNA, 21 nt, Homo sapiens
cuaaguagugaaagaaauuuu

SEQ ID NO: 1847 - RNA, 21 nt, Homo sapiens
aauuaaaauagccuucacuaa

SEQ ID NO: 1848 - RNA, 20 nt, Homo sapiens
caucagaaagcguuuacagu

SEQ ID NO: 1849 - RNA, 22 nt, Homo sapiens
acugauuugcuucaucacaugc

SEQ ID NO: 1850 - RNA, 24 nt, Homo sapiens
cagccaguauuacucaucacuuug

SEQ ID NO: 1851 - RNA, 20 nt, Homo sapiens
cggcgccuccuuuccgauuc

SEQ ID NO: 1852 - RNA, 21 nt, Homo sapiens
uaagaauuucuuucuucacaa

SEQ ID NO: 1853 - RNA, 22 nt, Homo sapiens
uccauuucucaagaugccuccu

SEQ ID NO: 1854 - RNA, 24 nt, Homo sapiens
gaaggguugggcuuuuuuuuuugu

SEQ ID NO: 1855 - RNA, 22 nt, Homo sapiens
gaacaaaaaaaaaaguacaaca

SEQ ID NO: 1856 - RNA, 23 nt, Homo sapiens
aaaucagaaucacaccuggggga

SEQ ID NO: 1857 - RNA, 23 nt, Homo sapiens
aaaacaccaagaucugaaggcua

SEQ ID NO: 1858 - RNA, 23 nt, Homo sapiens
gggcagccuucagauccaagugg

SEQ ID NO: 1859 - RNA, 21 nt, Homo sapiens
gagccgcgaggagccgagaga

SEQ ID NO: 1860 - RNA, 22 nt, Homo sapiens
guaccccuggagauucugauaa

SEQ ID NO: 1861 - RNA, 23 nt, Homo sapiens
gccugcaucaugaaaugcccucg

SEQ ID NO: 1862 - RNA, 22 nt, Homo sapiens
acauaucaugagugcacuucau

SEQ ID NO: 1863 - RNA, 23 nt, Homo sapiens
agaaaggacauagggugcugaug

SEQ ID NO: 1864 - RNA, 22 nt, Homo sapiens
cccaucuugcaacuaugucuuu

SEQ ID NO: 1865 - RNA, 22 nt, Homo sapiens
gcucuuuucauuaauguagaca

SEQ ID NO: 1866 - RNA, 22 nt, Homo sapiens
ccacagcaggcaggaugguccc

SEQ ID NO: 1867 - RNA, 22 nt, Homo sapiens
gcugcaccagccugccugcuga

SEQ ID NO: 1868 - RNA, 22 nt, Homo sapiens
cugggugcgggaugcaggguga

SEQ ID NO: 1869 - RNA, 22 nt, Homo sapiens
ggcccagcccagcccagcccac

SEQ ID NO: 1870 - RNA, 20 nt, Homo sapiens
ccugcagaccccgacccgcg

SEQ ID NO: 1871 - RNA, 22 nt, Homo sapiens
acaggcaugggaggucagguga

SEQ ID NO: 1872 - RNA, 22 nt, Homo sapiens
cucaccugagcucccgugccug

SEQ ID NO: 1873 - RNA, 21 nt, Homo sapiens
caggcacgggagcucagguga

SEQ ID NO: 1874 - RNA, 20 nt, Homo sapiens
ucaccugaccucccaugccu

SEQ ID NO: 1875 - RNA, 22 nt, Homo sapiens
ugaauccuugaauagguguguu

SEQ ID NO: 1876 - RNA, 24 nt, Homo sapiens
acucacaccuagguuccaaggauu

SEQ ID NO: 1877 - RNA, 22 nt, Homo sapiens
uacagauggauaccgugcaauu

SEQ ID NO: 1878 - RNA, 22 nt, Homo sapiens
aaauugcaucgugauccacccg

SEQ ID NO: 1879 - RNA, 22 nt, Homo sapiens
ugggcugggcucauuucauuuu

SEQ ID NO: 1880 - RNA, 21 nt, Homo sapiens
cccucggcgauccccgcggcu

SEQ ID NO: 1881 - RNA, 19 nt, Homo sapiens
cuuagacacucaggucccu

SEQ ID NO: 1882 - RNA, 19 nt, Homo sapiens
ggacucuacagacacaccu

SEQ ID NO: 1883 - RNA, 24 nt, Homo sapiens
ucauguaccagcgaccgggcuaug

SEQ ID NO: 1884 - RNA, 18 nt, Homo sapiens
uccucacaccuccagccg

SEQ ID NO: 1885 - RNA, 18 nt, Homo sapiens
cuucagucaacuucuuag

SEQ ID NO: 1886 - RNA, 19 nt, Homo sapiens
uuccucagcuuguccaguc

SEQ ID NO: 1887 - RNA, 21 nt, Homo sapiens
agcaacaccgcagcgacaagc

SEQ ID NO: 1888 - RNA, 17 nt, Homo sapiens
ccacccccgcacccgcc

SEQ ID NO: 1889 - RNA, 21 nt, Homo sapiens
aaucaccaauaaugggacaca

SEQ ID NO: 1890 - RNA, 22 nt, Homo sapiens
aucuccaugguguuuucuuaaa

SEQ ID NO: 1891 - RNA, 21 nt, Homo sapiens
ugcccucguagacaacacuca

SEQ ID NO: 1892 - RNA, 22 nt, Homo sapiens
auaaggauuuuuaggggcauua

SEQ ID NO: 1893 - RNA, 23 nt, Homo sapiens
cacaucugcccccaaaagucccu

SEQ ID NO: 1894 - RNA, 22 nt, Homo sapiens
auaaggauuuuuaggggcauua

SEQ ID NO: 1895 - RNA, 22 nt, Homo sapiens
acagcugccccugaaagucccu

SEQ ID NO: 1896 - RNA, 21 nt, Homo sapiens
ucaaaaugcucuccugucagu

SEQ ID NO: 1897 - RNA, 22 nt, Homo sapiens
cagcuguccgagucccagguca

SEQ ID NO: 1898 - RNA, 24 nt, Homo sapiens
caucagucacuacucaucauuuuc

SEQ ID NO: 1899 - RNA, 23 nt, Homo sapiens
gcgcccggccuguguggugcuca

SEQ ID NO: 1900 - RNA, 21 nt, Homo sapiens
ccgagcaccacgcagaccagc

SEQ ID NO: 1901 - RNA, 22 nt, Homo sapiens
aacucugucuuuacuccugaga

SEQ ID NO: 1902 - RNA, 22 nt, Homo sapiens
acucaugagugaagacagaguu

SEQ ID NO: 1903 - RNA, 18 nt, Homo sapiens
cgccgccccgcaccugcu

SEQ ID NO: 1904 - RNA, 21 nt, Homo sapiens
ucggcaucuacacuugcacug

SEQ ID NO: 1905 - RNA, 22 nt, Homo sapiens
aaagacccauggagaggaaggu

SEQ ID NO: 1906 - RNA, 22 nt, Homo sapiens
accuucuccucaaugggucuuu

SEQ ID NO: 1907 - RNA, 21 nt, Homo sapiens
auuuugaucaaucucuacauu

SEQ ID NO: 1908 - RNA, 23 nt, Homo sapiens
uauauuccguauacauauuccgu

SEQ ID NO: 1909 - RNA, 24 nt, Homo sapiens
uagagaaggacagcugugagcucu

SEQ ID NO: 1910 - RNA, 22 nt, Homo sapiens
ugcagacuaguccuuauuugau

SEQ ID NO: 1911 - RNA, 23 nt, Homo sapiens
aagauguuuuacaugagucucau

SEQ ID NO: 1912 - RNA, 21 nt, Homo sapiens
uauuccguauauacauuccau

SEQ ID NO: 1913 - RNA, 22 nt, Homo sapiens
ucaccauugcuaaagugcaauu

SEQ ID NO: 1914 - RNA, 22 nt, Homo sapiens
ggccaaucuuagguucuacaau

SEQ ID NO: 1915 - RNA, 22 nt, Homo sapiens
uugggggaguuccuuagagaug

SEQ ID NO: 1916 - RNA, 23 nt, Homo sapiens
gaaaucucuacagaagccccaua

SEQ ID NO: 1917 - RNA, 22 nt, Homo sapiens
agaguugcauauuagcaacagu

SEQ ID NO: 1918 - RNA, 20 nt, Homo sapiens
aaagcgugggggaaacacgg

SEQ ID NO: 1919 - RNA, 15 nt, Homo sapiens
aacccaggaucuccu

SEQ ID NO: 1920 - RNA, 22 nt, Homo sapiens
ggccguggccagagcccacgag

SEQ ID NO: 1921 - RNA, 22 nt, Homo sapiens
cacugcagggcucuggccacug

SEQ ID NO: 1922 - RNA, 22 nt, Homo sapiens
ccgguccguacaaacucugcag

SEQ ID NO: 1923 - RNA, 20 nt, Homo sapiens
cacagcagaguuuguacgga

SEQ ID NO: 1924 - RNA, 22 nt, Homo sapiens
gaugaagauuacuggggggaag

SEQ ID NO: 1925 - RNA, 23 nt, Homo sapiens
uccccuucccugccauauccuca

SEQ ID NO: 1926 - RNA, 23 nt, Homo sapiens
ccuacucccagggucaugcaaaa

SEQ ID NO: 1927 - RNA, 22 nt, Homo sapiens
ugcacaauccugugagugaguc

SEQ ID NO: 1928 - RNA, 22 nt, Homo sapiens
aguaguggaugaagcacugugu

SEQ ID NO: 1929 - RNA, 22 nt, Homo sapiens
gcacagagugcaucauccacua

SEQ ID NO: 1930 - RNA, 21 nt, Homo sapiens
cuaccuccaccuguaucauca

SEQ ID NO: 1931 - RNA, 22 nt, Homo sapiens
augauaacacagguagaaguag

SEQ ID NO: 1932 - RNA, 22 nt, Homo sapiens
ugauacuacuuccaaugucgca

SEQ ID NO: 1933 - RNA, 21 nt, Homo sapiens
aaggacguguacuaggucuaa

SEQ ID NO: 1934 - RNA, 22 nt, Homo sapiens
agucuucagguaggguaggaaa

SEQ ID NO: 1935 - RNA, 22 nt, Homo sapiens
ucauuuacuuucucuuacagau

SEQ ID NO: 1936 - RNA, 24 nt, Homo sapiens
acgucgcacgaacgccuguccggg

SEQ ID NO: 1937 - RNA, 22 nt, Homo sapiens
agaguggcaaagucuuuccaua

SEQ ID NO: 1938 - RNA, 21 nt, Homo sapiens
auauggaaagacuuugccacu

SEQ ID NO: 1939 - RNA, 22 nt, Homo sapiens
accacgauaucacaccucccag

SEQ ID NO: 1940 - RNA, 22 nt, Homo sapiens
ucccaggaaccaugauaucaca

SEQ ID NO: 1941 - RNA, 22 nt, Homo sapiens
accacaauaucacaccucccag

SEQ ID NO: 1942 - RNA, 22 nt, Homo sapiens
ucccaggaaccaugauaucaca

SEQ ID NO: 1943 - RNA, 22 nt, Homo sapiens
accacaauaucacaccucccag

SEQ ID NO: 1944 - RNA, 22 nt, Homo sapiens
cgagugugagaucacaccuccc

SEQ ID NO: 1945 - RNA, 22 nt, Homo sapiens
ucccaggaaccaugauaucaca

SEQ ID NO: 1946 - RNA, 22 nt, Homo sapiens
ucccaggaagcacgauaucaca

SEQ ID NO: 1947 - RNA, 23 nt, Homo sapiens
cuuugucuacgcuggguccaggu

SEQ ID NO: 1948 - RNA, 22 nt, Homo sapiens
gagaggaugacgcagacuuggu

SEQ ID NO: 1949 - RNA, 23 nt, Homo sapiens
guaccgagucuccaucauccacu

SEQ ID NO: 1950 - RNA, 24 nt, Homo sapiens
acuucugcagugucaguguggaac

SEQ ID NO: 1951 - RNA, 24 nt, Homo sapiens
caguauccacuccugaccagcagg

SEQ ID NO: 1952 - RNA, 21 nt, Homo sapiens
aaagaucaaccauguauuauu

SEQ ID NO: 1953 - RNA, 22 nt, Homo sapiens
gcgaauauaacacggucgaucu

SEQ ID NO: 1954 - RNA, 22 nt, Homo sapiens
accagguuccaccccagcaggc

SEQ ID NO: 1955 - RNA, 20 nt, Homo sapiens
accauccccaaacggauacc

SEQ ID NO: 1956 - RNA, 22 nt, Homo sapiens
acaggggagcacugcugccuuc

SEQ ID NO: 1957 - RNA, 23 nt, Homo sapiens
acacucaaaagauggcggcacuu

SEQ ID NO: 1958 - RNA, 20 nt, Homo sapiens
agugcccccacaguuugagu

SEQ ID NO: 1959 - RNA, 23 nt, Homo sapiens
gcacucaaacugugggggcacuu

SEQ ID NO: 1960 - RNA, 22 nt, Homo sapiens
aaagugccgccaucuuuugagu

SEQ ID NO: 1961 - RNA, 23 nt, Homo sapiens
acgcucaaaugucgcagcacuuu

SEQ ID NO: 1962 - RNA, 23 nt, Homo sapiens
acaccccaaaaucgaagcacuuc

SEQ ID NO: 1963 - RNA, 22 nt, Homo sapiens
ggaaagcgcccccauuuugagu

SEQ ID NO: 1964 - RNA, 22 nt, Homo sapiens
aauuacaauacaaucugauaag

SEQ ID NO: 1965 - RNA, 22 nt, Homo sapiens
cacuuaucagguuguauuauaa

SEQ ID NO: 1966 - RNA, 22 nt, Homo sapiens
aaugauaauacaaccugcuaag

SEQ ID NO: 1967 - RNA, 22 nt, Homo sapiens
cacuuagcagguuguauuauau

SEQ ID NO: 1968 - RNA, 22 nt, Homo sapiens
auauaauacaaccugcuaagug

SEQ ID NO: 1969 - RNA, 22 nt, Homo sapiens
agcacuuagcagguuguauuau

SEQ ID NO: 1970 - RNA, 22 nt, Homo sapiens
ucacgcgagccgaacgaacaaa

SEQ ID NO: 1971 - RNA, 21 nt, Homo sapiens
accauagaaggaaaaucuacc

SEQ ID NO: 1972 - RNA, 21 nt, Homo sapiens
acguggauuuuccucuaugau

SEQ ID NO: 1973 - RNA, 22 nt, Homo sapiens
uacucauagaaggagaaucuac

SEQ ID NO: 1974 - RNA, 22 nt, Homo sapiens
aacauggauuuuccucuaugau

SEQ ID NO: 1975 - RNA, 22 nt, Homo sapiens
aaacauagaaggaauauccacg

SEQ ID NO: 1976 - RNA, 21 nt, Homo sapiens
acguggaauuuccucuauguu

SEQ ID NO: 1977 - RNA, 21 nt, Homo sapiens
aacauagaaggaauauccacc

SEQ ID NO: 1978 - RNA, 22 nt, Homo sapiens
acaaaaguugccuuugugugau

SEQ ID NO: 1979 - RNA, 22 nt, Homo sapiens
gaauucaccaagggcaaccucu

SEQ ID NO: 1980 - RNA, 21 nt, Homo sapiens
ccuucugacuccaaguccagu

SEQ ID NO: 1981 - RNA, 22 nt, Homo sapiens
acacaggaccuggagucaggag

SEQ ID NO: 1982 - RNA, 19 nt, Homo sapiens
uucugccuccaaguccagu

SEQ ID NO: 1983 - RNA, 25 nt, Homo sapiens
ccacucuucugacuccaaguccagu

SEQ ID NO: 1984 - RNA, 20 nt, Homo sapiens
uuucugacuccaaguccagu

SEQ ID NO: 1985 - RNA, 19 nt, Homo sapiens
uccugacuccaaguccagu

SEQ ID NO: 1986 - RNA, 20 nt, Homo sapiens
cuucuggcuccaaguccagu

SEQ ID NO: 1987 - RNA, 20 nt, Homo sapiens
cuucugacuccaagcccagu

SEQ ID NO: 1988 - RNA, 21 nt, Homo sapiens
ccaucugacaccaaguccagu

SEQ ID NO: 1989 - RNA, 21 nt, Homo sapiens
ccuucugacuccuaguccagu

SEQ ID NO: 1990 - RNA, 19 nt, Homo sapiens
uucuggcuccaaauccagu

SEQ ID NO: 1991 - RNA, 22 nt, Homo sapiens
aguuaguggaccauguuacaua

SEQ ID NO: 1992 - RNA, 21 nt, Homo sapiens
ccuacguuccauagucuacca

SEQ ID NO: 1993 - RNA, 22 nt, Homo sapiens
aagauguggaccauauuacaua

SEQ ID NO: 1994 - RNA, 22 nt, Homo sapiens
gcgcauguucuauggucaacca

SEQ ID NO: 1995 - RNA, 22 nt, Homo sapiens
acagagagcuugcccuuguaua

SEQ ID NO: 1996 - RNA, 22 nt, Homo sapiens
auauacaaagggcaaccucgcu

SEQ ID NO: 1997 - RNA, 21 nt, Homo sapiens
aaguguuguccgugaaugauu

SEQ ID NO: 1998 - RNA, 22 nt, Homo sapiens
cgaauccaccacgaacaacuuc

SEQ ID NO: 1999 - RNA, 22 nt, Homo sapiens
agccacaaucaccuucugaucu

SEQ ID NO: 2000 - RNA, 20 nt, Homo sapiens
uaugaacaauuucuaggaau

SEQ ID NO: 2001 - RNA, 22 nt, Homo sapiens
ugugagccagccuggagcaccu

SEQ ID NO: 2002 - RNA, 22 nt, Homo sapiens
aaacagucuaccuacauugcuc

SEQ ID NO: 2003 - RNA, 22 nt, Homo sapiens
agacugcaggcccuagaggaca

SEQ ID NO: 2004 - RNA, 20 nt, Homo sapiens
ugucuugguuuuaugccuuu

SEQ ID NO: 2005 - RNA, 22 nt, Homo sapiens
ugccuccuccaggauccacaca

SEQ ID NO: 2006 - RNA, 21 nt, Homo sapiens
acauguccauauuaugcguua

SEQ ID NO: 2007 - RNA, 22 nt, Homo sapiens
uuugggacugaucuugaugucu

SEQ ID NO: 2008 - RNA, 22 nt, Homo sapiens
agacaucaagaucagucccaaa

SEQ ID NO: 2009 - RNA, 22 nt, Homo sapiens
acuucucauuuucugguuccuu

SEQ ID NO: 2010 - RNA, 22 nt, Homo sapiens
aauaagaccaucuuuuccucaa

SEQ ID NO: 2011 - RNA, 26 nt, Homo sapiens
cugagaaccagccauuucuuccucuu

SEQ ID NO: 2012 - RNA, 20 nt, Homo sapiens
cccaccugcucaguccgagc

SEQ ID NO: 2013 - RNA, 21 nt, Homo sapiens
agucuccaucugcggcccugu

SEQ ID NO: 2014 - RNA, 21 nt, Homo sapiens
acugaguccuuuguucucugc

SEQ ID NO: 2015 - RNA, 22 nt, Homo sapiens
ucagagaguuaagauaaucagu

SEQ ID NO: 2016 - RNA, 23 nt, Homo sapiens
acaaggcauaugguacucagaga

SEQ ID NO: 2017 - RNA, 22 nt, Homo sapiens
aaagagucaagucaaggccaga

SEQ ID NO: 2018 - RNA, 23 nt, Homo sapiens
ugcugugggaccucuggccuuga

SEQ ID NO: 2019 - RNA, 22 nt, Homo sapiens
cccuaauccaacauuacuaguu

SEQ ID NO: 2020 - RNA, 22 nt, Homo sapiens
aguagcagucacauauacauau

SEQ ID NO: 2021 - RNA, 21 nt, Homo sapiens
caagagaacuaaaacuggagu

SEQ ID NO: 2022 - RNA, 22 nt, Homo sapiens
aggcuccacuuucaguucucuu

SEQ ID NO: 2023 - RNA, 21 nt, Homo sapiens
ucucugccugcuuuuuggcca

SEQ ID NO: 2024 - RNA, 22 nt, Homo sapiens
augccuaucaaauaucuaccug

SEQ ID NO: 2025 - RNA, 21 nt, Homo sapiens
acaggcagauaugugauaggc

SEQ ID NO: 2026 - RNA, 22 nt, Homo sapiens
gccgaagcuccaagguuccucc

SEQ ID NO: 2027 - RNA, 23 nt, Homo sapiens
aguggucuacucacaucagccuc

SEQ ID NO: 2028 - RNA, 22 nt, Homo sapiens
ucccagcugugcaaccugagca

SEQ ID NO: 2029 - RNA, 22 nt, Homo sapiens
cugccucaguuuccacaccuga

SEQ ID NO: 2030 - RNA, 22 nt, Homo sapiens
guggcuggugcucguaucuaca

SEQ ID NO: 2031 - RNA, 22 nt, Homo sapiens
ugcaucugccauacaccccuua

SEQ ID NO: 2032 - RNA, 23 nt, Homo sapiens
cccccauugcuacagccgccugu

SEQ ID NO: 2033 - RNA, 22 nt, Homo sapiens
ccggguuaucuacaagggaauu

SEQ ID NO: 2034 - RNA, 22 nt, Homo sapiens
gacauccuguggucugcgcgua

SEQ ID NO: 2035 - RNA, 22 nt, Homo sapiens
aagugggcugggauccgggcug

SEQ ID NO: 2036 - RNA, 20 nt, Homo sapiens
cagagcccgccccaacccac

SEQ ID NO: 2037 - RNA, 22 nt, Homo sapiens
uaugauccucaguuguguguaa

SEQ ID NO: 2038 - RNA, 21 nt, Homo sapiens
auguaauacuguuaucugaaa

SEQ ID NO: 2039 - RNA, 22 nt, Homo sapiens
auuucagguaacaguauugcuu

SEQ ID NO: 2040 - RNA, 23 nt, Homo sapiens
cgccaagugaagccugggggcua

SEQ ID NO: 2041 - RNA, 23 nt, Homo sapiens
ccggagcagcaggccagcccgaa

SEQ ID NO: 2042 - RNA, 21 nt, Homo sapiens
ucucgguuggccugcugcaca

SEQ ID NO: 2043 - RNA, 23 nt, Homo sapiens
auaucaacccucuccuaugcccu

SEQ ID NO: 2044 - RNA, 20 nt, Homo sapiens
cccccgccuccgccgccgcc

SEQ ID NO: 2045 - RNA, 22 nt, Homo sapiens
ugcccuggaacggggcuggcag

SEQ ID NO: 2046 - RNA, 23 nt, Homo sapiens
cuaaggcuaaugcuguacuuugu

SEQ ID NO: 2047 - RNA, 23 nt, Homo sapiens
gcauuaaccuuacaaugaccuuu

SEQ ID NO: 2048 - RNA, 22 nt, Homo sapiens
gugaaguagugcauuagccuca

SEQ ID NO: 2049 - RNA, 24 nt, Homo sapiens
acauuaaucuuccugcucucuaua

SEQ ID NO: 2050 - RNA, 23 nt, Homo sapiens
uaagguuaauuacgaugaagcac

SEQ ID NO: 2051 - RNA, 24 nt, Homo sapiens
acacccuggaugcaugcuuuccac

SEQ ID NO: 2052 - RNA, 22 nt, Homo sapiens
agggguucaccgagcaacauuc

SEQ ID NO: 2053 - RNA, 23 nt, Homo sapiens
augcaaaguugcucggguaaccu

SEQ ID NO: 2054 - RNA, 21 nt, Homo sapiens
acaggccaucuguguuauauu

SEQ ID NO: 2055 - RNA, 22 nt, Homo sapiens
gguuaguggaccguguuacaua

SEQ ID NO: 2056 - RNA, 21 nt, Homo sapiens
cguacgcuauacggucuacua

SEQ ID NO: 2057 - RNA, 23 nt, Homo sapiens
acggcuaguggaccaggugaagu

SEQ ID NO: 2058 - RNA, 23 nt, Homo sapiens
gcgcccaauuaaugucuguugau

SEQ ID NO: 2059 - RNA, 22 nt, Homo sapiens
gccuucugacccuaaguccagu

SEQ ID NO: 2060 - RNA, 23 nt, Homo sapiens
acugaggggccucagaccgagcu

SEQ ID NO: 2061 - RNA, 23 nt, Homo sapiens
aaagucucgcucucugccccuca

SEQ ID NO: 2062 - RNA, 21 nt, Homo sapiens
auagcagcgccucacguuuug

SEQ ID NO: 2063 - RNA, 22 nt, Homo sapiens
uucaaaacaugaauugcugcug

SEQ ID NO: 2064 - RNA, 17 nt, Homo sapiens
uuggcccuuuucucagg

SEQ ID NO: 2065 - RNA, 19 nt, Homo sapiens
uggugcugacucaguggcc

SEQ ID NO: 2066 - RNA, 18 nt, Homo sapiens
acccccuggacaugcccu

SEQ ID NO: 2067 - RNA, 22 nt, Homo sapiens
gggcggacacgacauucccgau

SEQ ID NO: 2068 - RNA, 23 nt, Homo sapiens
gagaugguggaguagcuccaggc

SEQ ID NO: 2069 - RNA, 17 nt, Homo sapiens
uccaucucugaacacug

SEQ ID NO: 2070 - RNA, 23 nt, Homo sapiens
ucaacgggagugaucgugucauu

SEQ ID NO: 2071 - RNA, 18 nt, Homo sapiens
accuucaucaggucagau

SEQ ID NO: 2072 - RNA, 18 nt, Homo sapiens
cucaguccccaccucugg

SEQ ID NO: 2073 - RNA, 17 nt, Homo sapiens
ccaaggcgguggcgggg

SEQ ID NO: 2074 - RNA, 22 nt, Homo sapiens
uccugaccccuagacccaacug

SEQ ID NO: 2075 - RNA, 19 nt, Homo sapiens
ugggacuccaugccccaag

SEQ ID NO: 2076 - RNA, 16 nt, Homo sapiens
ugggucccuguuuccu

SEQ ID NO: 2077 - RNA, 17 nt, Homo sapiens
cagguagucugaauguc

SEQ ID NO: 2078 - RNA, 18 nt, Homo sapiens
ggccaaggcacuuagaau

SEQ ID NO: 2079 - RNA, 17 nt, Homo sapiens
aaugaccaugacugagu

SEQ ID NO: 2080 - RNA, 19 nt, Homo sapiens
cccagagcugagcccacag

SEQ ID NO: 2081 - RNA, 16 nt, Homo sapiens
ggccaaggccuccuag

SEQ ID NO: 2082 - RNA, 16 nt, Homo sapiens
gugccaccgagcugga

SEQ ID NO: 2083 - RNA, 21 nt, Homo sapiens
cacauccugagaggaggagcc

SEQ ID NO: 2084 - RNA, 21 nt, Homo sapiens
gccagggcugucugugccugc

SEQ ID NO: 2085 - RNA, 20 nt, Homo sapiens
gcccuccccugacucccuga

SEQ ID NO: 2086 - RNA, 19 nt, Homo sapiens
ccccaccuuuucuuccccc

SEQ ID NO: 2087 - RNA, 18 nt, Homo sapiens
acaaucacuaguugaaug

SEQ ID NO: 2088 - RNA, 18 nt, Homo sapiens
cuguccaucagagaacac

SEQ ID NO: 2089 - RNA, 18 nt, Homo sapiens
cagggggagggacugcug

SEQ ID NO: 2090 - RNA, 17 nt, Homo sapiens
aaagaagugguaauugg

SEQ ID NO: 2091 - RNA, 17 nt, Homo sapiens
gcacaugagucacugag

SEQ ID NO: 2092 - RNA, 21 nt, Homo sapiens
guguacugugcucagaacugc

SEQ ID NO: 2093 - RNA, 18 nt, Homo sapiens
caagggcaaacccccuag

SEQ ID NO: 2094 - RNA, 16 nt, Homo sapiens
gaagccgggaggagag

SEQ ID NO: 2095 - RNA, 21 nt, Homo sapiens
gcucugcucagaacuacacuc

SEQ ID NO: 2096 - RNA, 18 nt, Homo sapiens
ccccccuccccgggaccc

SEQ ID NO: 2097 - RNA, 18 nt, Homo sapiens
uccuggaugcaaauuuua

SEQ ID NO: 2098 - RNA, 17 nt, Homo sapiens
aaacucgcugagcccca

SEQ ID NO: 2099 - RNA, 18 nt, Homo sapiens
auggggugaugugagccc

SEQ ID NO: 2100 - RNA, 18 nt, Homo sapiens
augagucggacucgccgc

SEQ ID NO: 2101 - RNA, 17 nt, Homo sapiens
gguaccaggaguggggu

SEQ ID NO: 2102 - RNA, 19 nt, Homo sapiens
aaagugcccucaagggaga

SEQ ID NO: 2103 - RNA, 17 nt, Homo sapiens
ggaaacucagcagacaa

SEQ ID NO: 2104 - RNA, 19 nt, Homo sapiens
ugauagcccugcacaaugc

SEQ ID NO: 2105 - RNA, 22 nt, Homo sapiens
acgguuuuaccagacaguauua

SEQ ID NO: 2106 - RNA, 19 nt, Homo sapiens
gagggaagaaaggagggca

SEQ ID NO: 2107 - RNA, 16 nt, Homo sapiens
agcuguuccugcugaa

SEQ ID NO: 2108 - RNA, 18 nt, Homo sapiens
ccaaggccggcccagggg

SEQ ID NO: 2109 - RNA, 17 nt, Homo sapiens
cuguuccugucaggcug

SEQ ID NO: 2110 - RNA, 17 nt, Homo sapiens
cccugcuguagacuccc

SEQ ID NO: 2111 - RNA, 18 nt, Homo sapiens
aaggaaaacauugcacug

SEQ ID NO: 2112 - RNA, 17 nt, Homo sapiens
ugagccugagcccacau

SEQ ID NO: 2113 - RNA, 16 nt, Homo sapiens
cacagacaggaaggca

SEQ ID NO: 2114 - RNA, 22 nt, Homo sapiens
cugccuccuccuccugucccag

SEQ ID NO: 2115 - RNA, 18 nt, Homo sapiens
gccucucaugucaccagc

SEQ ID NO: 2116 - RNA, 18 nt, Homo sapiens
gaaguaguccagcuccca

SEQ ID NO: 2117 - RNA, 20 nt, Homo sapiens
ucacaagugaaguaguggga

SEQ ID NO: 2118 - RNA, 18 nt, Homo sapiens
cucgcugagccacacugg

SEQ ID NO: 2119 - RNA, 17 nt, Homo sapiens
cuguccucagcucagaa

SEQ ID NO: 2120 - RNA, 17 nt, Homo sapiens
ugcccuggacaugccgg

SEQ ID NO: 2121 - RNA, 18 nt, Homo sapiens
gaacuggaggugucuagg

SEQ ID NO: 2122 - RNA, 17 nt, Homo sapiens
uacugccuuucucucca

SEQ ID NO: 2123 - RNA, 19 nt, Homo sapiens
ggaaacaggaaaaaacauu

SEQ ID NO: 2124 - RNA, 18 nt, Homo sapiens
aagaagaaacuccaggga

SEQ ID NO: 2125 - RNA, 18 nt, Homo sapiens
uggaauccuagacuccag

SEQ ID NO: 2126 - RNA, 16 nt, Homo sapiens
gggacaugaaugcugc

SEQ ID NO: 2127 - RNA, 18 nt, Homo sapiens
cacacucagcucucuuuc

SEQ ID NO: 2128 - RNA, 19 nt, Homo sapiens
uggggacaggaacaaggcc

SEQ ID NO: 2129 - RNA, 20 nt, Homo sapiens
ggguuuggggccagggggcu

SEQ ID NO: 2130 - RNA, 22 nt, Homo sapiens
agaagcccugcaagacgaccug

SEQ ID NO: 2131 - RNA, 18 nt, Homo sapiens
cugucccauuucccagag

SEQ ID NO: 2132 - RNA, 18 nt, Homo sapiens
guccagcucagaaagcgg

SEQ ID NO: 2133 - RNA, 21 nt, Homo sapiens
ugcaugacggccugcaagaca

SEQ ID NO: 2134 - RNA, 17 nt, Homo sapiens
caccagcuagccucacc

SEQ ID NO: 2135 - RNA, 17 nt, Homo sapiens
aaacucccuggcaaugu

SEQ ID NO: 2136 - RNA, 17 nt, Homo sapiens
agcauguacccacagug

SEQ ID NO: 2137 - RNA, 17 nt, Homo sapiens
guggcuuugcucaggga

SEQ ID NO: 2138 - RNA, 18 nt, Homo sapiens
aggaagcuacagaauccc

SEQ ID NO: 2139 - RNA, 21 nt, Homo sapiens
cgcagggcgguccaccgcuaa

SEQ ID NO: 2140 - RNA, 21 nt, Homo sapiens
ccccacgcgcugagcccacag

SEQ ID NO: 2141 - RNA, 18 nt, Homo sapiens
ucugaggcuguggggcug

SEQ ID NO: 2142 - RNA, 21 nt, Homo sapiens
agacauggaggagccauccag

SEQ ID NO: 2143 - RNA, 20 nt, Homo sapiens
uuaagguuagggucucaggg

SEQ ID NO: 2144 - RNA, 18 nt, Homo sapiens
ucacugagacaagugcaa

SEQ ID NO: 2145 - RNA, 23 nt, Homo sapiens
ccacccaaugaccuacuccaaga

SEQ ID NO: 2146 - RNA, 20 nt, Homo sapiens
gucugggagacagaggaaca

SEQ ID NO: 2147 - RNA, 19 nt, Homo sapiens
ccagucccccaugcaagcc

SEQ ID NO: 2148 - RNA, 17 nt, Homo sapiens
aauccugggaaaacugg

SEQ ID NO: 2149 - RNA, 19 nt, Homo sapiens
guggaacuagggucucagg

SEQ ID NO: 2150 - RNA, 22 nt, Homo sapiens
acaccgaggagcccaucaugau

SEQ ID NO: 2151 - RNA, 19 nt, Homo sapiens
gcaaggcucugaucugagg

SEQ ID NO: 2152 - RNA, 18 nt, Homo sapiens
cccuccgggaagcccacc

SEQ ID NO: 2153 - RNA, 18 nt, Homo sapiens
cugcugaguccugcagug

SEQ ID NO: 2154 - RNA, 17 nt, Homo sapiens
ugcagucuccucccuca

SEQ ID NO: 2155 - RNA, 18 nt, Homo sapiens
ccaucuuccuucagccuc

SEQ ID NO: 2156 - RNA, 22 nt, Homo sapiens
cucagcuacagacaucagugac

SEQ ID NO: 2157 - RNA, 22 nt, Homo sapiens
uagcuccuuuccacagacaggu

SEQ ID NO: 2158 - RNA, 21 nt, Homo sapiens
uggguacuuccugaugcuuuu

SEQ ID NO: 2159 - RNA, 21 nt, Homo sapiens
uuguugcuuuuuggugccuau

SEQ ID NO: 2160 - RNA, 22 nt, Homo sapiens
gcaugggaacaaaaaggcaacu

SEQ ID NO: 2161 - RNA, 22 nt, Homo sapiens
uaguccauuuugaguuaacucu

SEQ ID NO: 2162 - RNA, 22 nt, Homo sapiens
augguccugcugaaucccaaca

SEQ ID NO: 2163 - RNA, 17 nt, Homo sapiens
aaaguacguccaucuuc

SEQ ID NO: 2164 - RNA, 21 nt, Homo sapiens
acucuucagacucuauucaga

SEQ ID NO: 2165 - RNA, 22 nt, Homo sapiens
gcuccauguucccgucuccuug

SEQ ID NO: 2166 - RNA, 20 nt, Homo sapiens
cgccucucagcccagcuuuu

SEQ ID NO: 2167 - RNA, 18 nt, Homo sapiens
cuccgcucacuccagccu

SEQ ID NO: 2168 - RNA, 22 nt, Homo sapiens
accuucuaguuuucagagucgc

SEQ ID NO: 2169 - RNA, 20 nt, Homo sapiens
aggcaucuugcagagucuuu

SEQ ID NO: 2170 - RNA, 21 nt, Homo sapiens
augucccacccccacuccugu

SEQ ID NO: 2171 - RNA, 21 nt, Homo sapiens
acaggaguggggggugggacg

SEQ ID NO: 2172 - RNA, 18 nt, Homo sapiens
uucuacuuuacuucuccu

SEQ ID NO: 2173 - RNA, 22 nt, Homo sapiens
ccucugugugagcucuggccau

SEQ ID NO: 2174 - RNA, 21 nt, Homo sapiens
auccacuucugccuguccugc

SEQ ID NO: 2175 - RNA, 22 nt, Homo sapiens
uuguccacuucuuccugcccug

SEQ ID NO: 2176 - RNA, 22 nt, Homo sapiens
ggcagggcaggcagaaguggac

SEQ ID NO: 2177 - RNA, 21 nt, Homo sapiens
aaccuuuguacccugagccca

SEQ ID NO: 2178 - RNA, 21 nt, Homo sapiens
acugucuuuucuaagccugug

SEQ ID NO: 2179 - RNA, 22 nt, Homo sapiens
augccuccaagguaucagucac

SEQ ID NO: 2180 - RNA, 22 nt, Homo sapiens
caagccagcaagccccacgaca

SEQ ID NO: 2181 - RNA, 17 nt, Homo sapiens
uacaaucuccucccugu

SEQ ID NO: 2182 - RNA, 17 nt, Homo sapiens
ccucccucuuguccggc

SEQ ID NO: 2183 - RNA, 17 nt, Homo sapiens
aaaacccacgccuccaa

SEQ ID NO: 2184 - RNA, 18 nt, Homo sapiens
cgccucuuccaacucgag

SEQ ID NO: 2185 - RNA, 21 nt, Homo sapiens
uggauuguuucuuuugccgug

SEQ ID NO: 2186 - RNA, 22 nt, Homo sapiens
ugcacggcaaaagaaacaaucu

SEQ ID NO: 2187 - RNA, 22 nt, Homo sapiens
acccaugucacugccagcccug

SEQ ID NO: 2188 - RNA, 22 nt, Homo sapiens
gccaagggaauggcagggaaau

SEQ ID NO: 2189 - RNA, 17 nt, Homo sapiens
aaacaacagcccccacc

SEQ ID NO: 2190 - RNA, 20 nt, Homo sapiens
uaccccuagaccaaggagcc

SEQ ID NO: 2191 - RNA, 22 nt, Homo sapiens
ugccucgcgcagccccgggacg

SEQ ID NO: 2192 - RNA, 22 nt, Homo sapiens
ucaccacuucuccaaaucccca

SEQ ID NO: 2193 - RNA, 17 nt, Homo sapiens
uguccucagcucuacca

SEQ ID NO: 2194 - RNA, 23 nt, Homo sapiens
aucacuuaaggccaagaauucaa

SEQ ID NO: 2195 - RNA, 20 nt, Homo sapiens
aaccgcuacagaccaagcuc

SEQ ID NO: 2196 - RNA, 20 nt, Homo sapiens
uggugccgugacucggaucc

SEQ ID NO: 2197 - RNA, 17 nt, Homo sapiens
aaaaacacacacacccu

SEQ ID NO: 2198 - RNA, 17 nt, Homo sapiens
aaaaggaagccaccagg

SEQ ID NO: 2199 - RNA, 22 nt, Homo sapiens
uacgccagucaauaccuuguga

SEQ ID NO: 2200 - RNA, 19 nt, Homo sapiens
uucuuccacaccuaccucu

SEQ ID NO: 2201 - RNA, 22 nt, Homo sapiens
cuccaccuccuccgccuccugg

SEQ ID NO: 2202 - RNA, 22 nt, Homo sapiens
aagguaaauucacaaccacuau

SEQ ID NO: 2203 - RNA, 23 nt, Homo sapiens
gccuagcccuacuagucucaauc

SEQ ID NO: 2204 - RNA, 23 nt, Homo sapiens
uucccaagccacccuccguguca

SEQ ID NO: 2205 - RNA, 17 nt, Homo sapiens
ggccccaccccagucuc

SEQ ID NO: 2206 - RNA, 21 nt, Homo sapiens
uauugcaucuauccaaaccuu

SEQ ID NO: 2207 - RNA, 22 nt, Homo sapiens
uccccuggucagacuacuugag

SEQ ID NO: 2208 - RNA, 18 nt, Homo sapiens
ccccgccggcccgcaccc

SEQ ID NO: 2209 - RNA, 22 nt, Homo sapiens
aagcccauaacuaccgccgcca

SEQ ID NO: 2210 - RNA, 18 nt, Homo sapiens
aucucauccuucugcucu

SEQ ID NO: 2211 - RNA, 22 nt, Homo sapiens
uccgagcgacccuagagggagc

SEQ ID NO: 2212 - RNA, 21 nt, Homo sapiens
ucucggcuuccacguuugcca

SEQ ID NO: 2213 - RNA, 22 nt, Homo sapiens
ugggaacuuaguagagguuuaa

SEQ ID NO: 2214 - RNA, 18 nt, Homo sapiens
ggugggggguguuguuuu

SEQ ID NO: 2215 - RNA, 22 nt, Homo sapiens
cuagugcucuccguuacaagua

SEQ ID NO: 2216 - RNA, 22 nt, Homo sapiens
uuguggcuggucaugaggcuaa

SEQ ID NO: 2217 - RNA, 21 nt, Homo sapiens
uuagucucaugaucagacaca

SEQ ID NO: 2218 - RNA, 22 nt, Homo sapiens
caagggaccaagcauucauuau

SEQ ID NO: 2219 - RNA, 22 nt, Homo sapiens
caggaaggauuuagggacaggc

SEQ ID NO: 2220 - RNA, 22 nt, Homo sapiens
cuauuaaggacauuugugauuc

SEQ ID NO: 2221 - RNA, 22 nt, Homo sapiens
auuaaggacauuugugauugau

SEQ ID NO: 2222 - RNA, 17 nt, Homo sapiens
gaggcugagcugaggag

SEQ ID NO: 2223 - RNA, 22 nt, Homo sapiens
cgcgcggccgugcucggagcag

SEQ ID NO: 2224 - RNA, 22 nt, Homo sapiens
uugcauauguaggaugucccau

SEQ ID NO: 2225 - RNA, 21 nt, Homo sapiens
agccaaguggaaguuacuuua

SEQ ID NO: 2226 - RNA, 17 nt, Homo sapiens
ggagugggcuggugguu

SEQ ID NO: 2227 - RNA, 22 nt, Homo sapiens
uuucuauuucucaguggggcuc

SEQ ID NO: 2228 - RNA, 22 nt, Homo sapiens
aacccagugggcuauggaaaug

SEQ ID NO: 2229 - RNA, 17 nt, Homo sapiens
gggguggucuguuguug

SEQ ID NO: 2230 - RNA, 20 nt, Homo sapiens
aaaaggcgggagaagcccca

SEQ ID NO: 2231 - RNA, 20 nt, Homo sapiens
uaacggccgcgguacccuaa

SEQ ID NO: 2232 - RNA, 17 nt, Homo sapiens
gcugggcgaggcuggca

SEQ ID NO: 2233 - RNA, 19 nt, Homo sapiens
agagcuggcugaagggcag

SEQ ID NO: 2234 - RNA, 18 nt, Homo sapiens
agggggcgggcuccggcg

SEQ ID NO: 2235 - RNA, 21 nt, Homo sapiens
uggggcuagugaugcaggacg

SEQ ID NO: 2236 - RNA, 22 nt, Homo sapiens
ucugguaagagauuugggcaua

SEQ ID NO: 2237 - RNA, 22 nt, Homo sapiens
aauguggacuggugugaccaaa

SEQ ID NO: 2238 - RNA, 17 nt, Homo sapiens
ggggcugggcgcgcgcc

SEQ ID NO: 2239 - RNA, 21 nt, Homo sapiens
agaaggccuuuccaucucugu

SEQ ID NO: 2240 - RNA, 22 nt, Homo sapiens
ccagacuguggcugaccagagg

SEQ ID NO: 2241 - RNA, 21 nt, Homo sapiens
aauguaaacaggcuuuuugcu

SEQ ID NO: 2242 - RNA, 22 nt, Homo sapiens
gaggaaacugaagcugagaggg

SEQ ID NO: 2243 - RNA, 17 nt, Homo sapiens
cuccgggacggcugggc

SEQ ID NO: 2244 - RNA, 22 nt, Homo sapiens
ugggcuggcagggcaagugcug

SEQ ID NO: 2245 - RNA, 17 nt, Homo sapiens
aagacugagaggaggga

SEQ ID NO: 2246 - RNA, 22 nt, Homo sapiens
uggcaguguauuguuagcuggu

SEQ ID NO: 2247 - RNA, 22 nt, Homo sapiens
cagccacaacuacccugccacu

SEQ ID NO: 2248 - RNA, 22 nt, Homo sapiens
aggcaguguauuguuagcuggc

SEQ ID NO: 2249 - RNA, 23 nt, Homo sapiens
uugcuaguugcacuccucucugu

SEQ ID NO: 2250 - RNA, 25 nt, Homo sapiens
uaggcaguguauugcuagcggcugu

SEQ ID NO: 2251 - RNA, 17 nt, Homo sapiens
ugagguaguaguuucuu

SEQ ID NO: 2252 - RNA, 21 nt, Homo sapiens
uaugugaccucggaugaauca

SEQ ID NO: 2253 - RNA, 22 nt, Homo sapiens
gcugaugaugauggugcugaag

SEQ ID NO: 2254 - RNA, 22 nt, Homo sapiens
uuuaagcaggaaauagaauuua

SEQ ID NO: 2255 - RNA, 22 nt, Homo sapiens
ugugacaauagagaugaacaug

SEQ ID NO: 2256 - RNA, 18 nt, Homo sapiens
aggcugggcugggacgga

SEQ ID NO: 2257 - RNA, 20 nt, Homo sapiens
aaauggguggucugaggcaa

SEQ ID NO: 2258 - RNA, 20 nt, Homo sapiens
cuggguugggcugggcuggg

SEQ ID NO: 2259 - RNA, 17 nt, Homo sapiens
gcggggcugggcgcgcg

SEQ ID NO: 2260 - RNA, 22 nt, Homo sapiens
acuaaaggauauagaagguuuu

SEQ ID NO: 2261 - RNA, 22 nt, Homo sapiens
auuggggacauuuugcauucau

SEQ ID NO: 2262 - RNA, 22 nt, Homo sapiens
uuuugcgauguguuccuaauau

SEQ ID NO: 2263 - RNA, 22 nt, Homo sapiens
uugggaucauuuugcauccaua

SEQ ID NO: 2264 - RNA, 22 nt, Homo sapiens
uuuugcaauauguuccugaaua

SEQ ID NO: 2265 - RNA, 22 nt, Homo sapiens
ugagggaguaggauguaugguu

SEQ ID NO: 2266 - RNA, 22 nt, Homo sapiens
gaagaacuguugcauuugcccu

SEQ ID NO: 2267 - RNA, 22 nt, Homo sapiens
cagggccucacuguaucgccca

SEQ ID NO: 2268 - RNA, 22 nt, Homo sapiens
agacugacggcuggaggcccau

SEQ ID NO: 2269 - RNA, 18 nt, Homo sapiens
acaggcaggauuggggaa

SEQ ID NO: 2270 - RNA, 22 nt, Homo sapiens
aggacuggacucccggcagccc

SEQ ID NO: 2271 - RNA, 17 nt, Homo sapiens
gggagaagggucggggc

SEQ ID NO: 2272 - RNA, 25 nt, Homo sapiens
aaauaugaugaaacucacagcugag

SEQ ID NO: 2273 - RNA, 26 nt, Homo sapiens
gcucagggaugauaacugugcugaga

SEQ ID NO: 2274 - RNA, 18 nt, Homo sapiens
cagcagugcgcagggcug

SEQ ID NO: 2275 - RNA, 22 nt, Homo sapiens
aaaccguuaccauuacugaguu

SEQ ID NO: 2276 - RNA, 22 nt, Homo sapiens
uagcaagagaaccauuaccauu

SEQ ID NO: 2277 - RNA, 22 nt, Homo sapiens
uuggacagaaaacacgcaggaa

SEQ ID NO: 2278 - RNA, 20 nt, Homo sapiens
ccugcguguuuucuguccaa

SEQ ID NO: 2279 - RNA, 22 nt, Homo sapiens
uuuggacagaaaacacgcaggu

SEQ ID NO: 2280 - RNA, 20 nt, Homo sapiens
ccugcguguuuucuguccaa

SEQ ID NO: 2281 - RNA, 22 nt, Homo sapiens
gcuaaggaaguccugugcucag

SEQ ID NO: 2282 - RNA, 21 nt, Homo sapiens
ugacucugccuguaggccggu

SEQ ID NO: 2283 - RNA, 21 nt, Homo sapiens
gaccgagagggccucggcugu

SEQ ID NO: 2284 - RNA, 22 nt, Homo sapiens
cucaucugcaaagaaguaagug

SEQ ID NO: 2285 - RNA, 22 nt, Homo sapiens
ugagacaggcuuaugcugcuau

SEQ ID NO: 2286 - RNA, 22 nt, Homo sapiens
auagcagcaugaaccugucuca

SEQ ID NO: 2287 - RNA, 20 nt, Homo sapiens
gagacagguucaugcugcua

SEQ ID NO: 2288 - RNA, 21 nt, Homo sapiens
auagcagcauaagccugucuc

SEQ ID NO: 2289 - RNA, 21 nt, Homo sapiens
ggggggaugugcaugcugguu

SEQ ID NO: 2290 - RNA, 22 nt, Homo sapiens
aacuguuugcagaggaaacuga

SEQ ID NO: 2291 - RNA, 22 nt, Homo sapiens
gcugacagcagggcuggccgcu

SEQ ID NO: 2292 - RNA, 22 nt, Homo sapiens
uggucugcaaagagaugacugu

SEQ ID NO: 2293 - RNA, 22 nt, Homo sapiens
ucauuauauguaugaucuggac

SEQ ID NO: 2294 - RNA, 21 nt, Homo sapiens
auuggacugcugauggcccgu

SEQ ID NO: 2295 - RNA, 22 nt, Homo sapiens
aggccaucagcaguccaaugaa

SEQ ID NO: 2296 - RNA, 18 nt, Homo sapiens
cccagcaggacgggagcg

SEQ ID NO: 2297 - RNA, 17 nt, Homo sapiens
auggagaaggcuucuga

SEQ ID NO: 2298 - RNA, 17 nt, Homo sapiens
ccccggggagcccggcg

SEQ ID NO: 2299 - RNA, 22 nt, Homo sapiens
uggaaggagguugccggacgcu

SEQ ID NO: 2300 - RNA, 17 nt, Homo sapiens
ggauggaggaggggucu

SEQ ID NO: 2301 - RNA, 17 nt, Homo sapiens
guggaccuggcugggac

SEQ ID NO: 2302 - RNA, 21 nt, Homo sapiens
ucgugcauauaucuaccacau

SEQ ID NO: 2303 - RNA, 21 nt, Homo sapiens
ugugguagauauaugcacgau

SEQ ID NO: 2304 - RNA, 22 nt, Homo sapiens
ugagccgagcugagcuuagcug

SEQ ID NO: 2305 - RNA, 22 nt, Homo sapiens
gagcuuggaugagcugggcuga

SEQ ID NO: 2306 - RNA, 22 nt, Homo sapiens
gcugaacugggcugagcugggc

SEQ ID NO: 2307 - RNA, 21 nt, Homo sapiens
uuaguccugccuguagguuua

SEQ ID NO: 2308 - RNA, 23 nt, Homo sapiens
uagugcaauauugcuuauagggu

SEQ ID NO: 2309 - RNA, 22 nt, Homo sapiens
acccuaucaauauugucucugc

SEQ ID NO: 2310 - RNA, 21 nt, Homo sapiens
gcaguccaugggcauauacac

SEQ ID NO: 2311 - RNA, 22 nt, Homo sapiens
uaugugccuuuggacuacaucg

SEQ ID NO: 2312 - RNA, 22 nt, Homo sapiens
ugccgcccucucgcugcucuag

SEQ ID NO: 2313 - RNA, 23 nt, Homo sapiens
gagggcagcguggguguggcgga

SEQ ID NO: 2314 - RNA, 22 nt, Homo sapiens
aggagcuagccaggcauaugca

SEQ ID NO: 2315 - RNA, 20 nt, Homo sapiens
auaugccuggcuagcuccuc

SEQ ID NO: 2316 - RNA, 19 nt, Homo sapiens
cggcgcgaccggcccgggg

SEQ ID NO: 2317 - RNA, 21 nt, Homo sapiens
ucuugaagucagaacccgcaa

SEQ ID NO: 2318 - RNA, 22 nt, Homo sapiens
aacucguguucaaagccuuuag

SEQ ID NO: 2319 - RNA, 22 nt, Homo sapiens
uacuaacugcagauucaaguga

SEQ ID NO: 2320 - RNA, 23 nt, Homo sapiens
ccuggacaccgcucagccggccg

SEQ ID NO: 2321 - RNA, 21 nt, Homo sapiens
acucggcugcgguggacaagu

SEQ ID NO: 2322 - RNA, 20 nt, Homo sapiens
ucacucucaccuugcuuugc

SEQ ID NO: 2323 - RNA, 22 nt, Homo sapiens
uugcuaaguaggcugagauuga

SEQ ID NO: 2324 - RNA, 22 nt, Homo sapiens
cacccccuguuuccuggcccac

SEQ ID NO: 2325 - RNA, 23 nt, Homo sapiens
ugggccagggagcagcugguggg

SEQ ID NO: 2326 - RNA, 24 nt, Homo sapiens
ugcccaugccauacuuuugccuca

SEQ ID NO: 2327 - RNA, 22 nt, Homo sapiens
auggcaucguccccugguggcu

SEQ ID NO: 2328 - RNA, 22 nt, Homo sapiens
gacacaugaccauaaaugcuaa

SEQ ID NO: 2329 - RNA, 23 nt, Homo sapiens
uggagagagaaaagagacagaag

SEQ ID NO: 2330 - RNA, 22 nt, Homo sapiens
agacaguaguucuugccugguu

SEQ ID NO: 2331 - RNA, 19 nt, Homo sapiens
accaggcaagaaauauugu

SEQ ID NO: 2332 - RNA, 21 nt, Homo sapiens
auugucccucucccuucccag

SEQ ID NO: 2333 - RNA, 22 nt, Homo sapiens
acugggaagaggagcugaggga

SEQ ID NO: 2334 - RNA, 23 nt, Homo sapiens
gaagauggugcugugcugaggaa

SEQ ID NO: 2335 - RNA, 20 nt, Homo sapiens
ugugggacugcaaaugggag

SEQ ID NO: 2336 - RNA, 21 nt, Homo sapiens
ucugaggccugccucucccca

SEQ ID NO: 2337 - RNA, 24 nt, Homo sapiens
ugggcgaggggugggcucucagag

SEQ ID NO: 2338 - RNA, 21 nt, Homo sapiens
agguagaaugaggccugacau

SEQ ID NO: 2339 - RNA, 19 nt, Homo sapiens
ucaggccucuuucuaccuu

SEQ ID NO: 2340 - RNA, 20 nt, Homo sapiens
cggggugggugaggucgggc

SEQ ID NO: 2341 - RNA, 22 nt, Homo sapiens
guucuguuaacccauccccuca

SEQ ID NO: 2342 - RNA, 22 nt, Homo sapiens
aggggacugguuaauagaacua

SEQ ID NO: 2343 - RNA, 23 nt, Homo sapiens
uggaguuaaggguugcuuggaga

SEQ ID NO: 2344 - RNA, 22 nt, Homo sapiens
ucucugagcaaggcuuaacacc

SEQ ID NO: 2345 - RNA, 22 nt, Homo sapiens
ugugggaucuggaggcaucugg

SEQ ID NO: 2346 - RNA, 21 nt, Homo sapiens
acccucgucagguccccgggg

SEQ ID NO: 2347 - RNA, 22 nt, Homo sapiens
caccggggauggcagagggucg

SEQ ID NO: 2348 - RNA, 23 nt, Homo sapiens
ugggcugagggcaggaggccugu

SEQ ID NO: 2349 - RNA, 23 nt, Homo sapiens
aauguggaaguggucugaggcau

SEQ ID NO: 2350 - RNA, 23 nt, Homo sapiens
gugaguguggauccuggaggaau

SEQ ID NO: 2351 - RNA, 22 nt, Homo sapiens
uuucuucuuagacauggcaacg

SEQ ID NO: 2352 - RNA, 22 nt, Homo sapiens
cugccaugucuaagaagaaaac

SEQ ID NO: 2353 - RNA, 22 nt, Homo sapiens
uuucuucuuagacauggcagcu

SEQ ID NO: 2354 - RNA, 19 nt, Homo sapiens
uugccaugucuaagaagaa

SEQ ID NO: 2355 - RNA, 23 nt, Homo sapiens
auacacauacacgcaacacacau

SEQ ID NO: 2356 - RNA, 23 nt, Homo sapiens
ugcagcucugguggaaaauggag

SEQ ID NO: 2357 - RNA, 22 nt, Homo sapiens
caggauccacagagcuagucca

SEQ ID NO: 2358 - RNA, 22 nt, Homo sapiens
aacuagcucuguggauccugac

SEQ ID NO: 2359 - RNA, 22 nt, Homo sapiens
aaagauagacaauuggcuaaau

SEQ ID NO: 2360 - RNA, 22 nt, Homo sapiens
uuagccaauuguccaucuuuag

SEQ ID NO: 2361 - RNA, 22 nt, Homo sapiens
aaagauggacaauuggcuaaau

SEQ ID NO: 2362 - RNA, 24 nt, Homo sapiens
agcugagcuccauggacgugcagu

SEQ ID NO: 2363 - RNA, 22 nt, Homo sapiens
cuuccggucugugagccccguc

SEQ ID NO: 2364 - RNA, 22 nt, Homo sapiens
uggggugcccacuccgcaaguu

SEQ ID NO: 2365 - RNA, 26 nt, Homo sapiens
cucggccgcggcgcguagcccccgcc

SEQ ID NO: 2366 - RNA, 23 nt, Homo sapiens
cugggggacgcgugagcgcgagc

SEQ ID NO: 2367 - RNA, 21 nt, Homo sapiens
cauacaaucugacauguauuu

SEQ ID NO: 2368 - RNA, 21 nt, Homo sapiens
auacaugucagauuguaugcc

SEQ ID NO: 2369 - RNA, 23 nt, Homo sapiens
uugcaugucagauuguaauuccc

SEQ ID NO: 2370 - RNA, 21 nt, Homo sapiens
ucccuccuucuguccccacag

SEQ ID NO: 2371 - RNA, 22 nt, Homo sapiens
acuggggagcagaaggagaacc

SEQ ID NO: 2372 - RNA, 23 nt, Homo sapiens
gaaaauccuuuuuguuuuuccag

SEQ ID NO: 2373 - RNA, 23 nt, Homo sapiens
agggaaaaaaaaaaggauuuguc

SEQ ID NO: 2374 - RNA, 22 nt, Homo sapiens
uguguccgggaaguggaggagg

SEQ ID NO: 2375 - RNA, 22 nt, Homo sapiens
ugaaguuacaucauggucgcuu

SEQ ID NO: 2376 - RNA, 22 nt, Homo sapiens
aagcgaccaugauguaacuuca

SEQ ID NO: 2377 - RNA, 21 nt, Homo sapiens
uuagugcauagucuuuggucu

SEQ ID NO: 2378 - RNA, 22 nt, Homo sapiens
accgaagacugugcgcuaaucu

SEQ ID NO: 2379 - RNA, 21 nt, Homo sapiens
uuacacagcuggacagaggca

SEQ ID NO: 2380 - RNA, 22 nt, Homo sapiens
uccaggcaggagccggacugga

SEQ ID NO: 2381 - RNA, 21 nt, Homo sapiens
cugggcucgggacgcgcggcu

SEQ ID NO: 2382 - RNA, 22 nt, Homo sapiens
ggggcugugauugaccagcagg

SEQ ID NO: 2383 - RNA, 22 nt, Homo sapiens
cacuguuucaccacuggcucuu

SEQ ID NO: 2384 - RNA, 21 nt, Homo sapiens
gagccaguggugagacaguga

SEQ ID NO: 2385 - RNA, 22 nt, Homo sapiens
ucugugagaccaaagaacuacu

SEQ ID NO: 2386 - RNA, 22 nt, Homo sapiens
uuguucuuuggucuuucagcca

SEQ ID NO: 2387 - RNA, 22 nt, Homo sapiens
aagguauuguucagacuuauga

SEQ ID NO: 2388 - RNA, 22 nt, Homo sapiens
ucugugauagagauucuuugcu

SEQ ID NO: 2389 - RNA, 21 nt, Homo sapiens
ucugaauuguaagaguuguua

SEQ ID NO: 2390 - RNA, 23 nt, Homo sapiens
agaacucuugcagucuuagaugu

SEQ ID NO: 2391 - RNA, 22 nt, Homo sapiens
aacgggaaugcaggcuguaucu

SEQ ID NO: 2392 - RNA, 23 nt, Homo sapiens
ucugaguuccuggagccuggucu

SEQ ID NO: 2393 - RNA, 23 nt, Homo sapiens
uggagauccagugcucgcccgau

SEQ ID NO: 2394 - RNA, 22 nt, Homo sapiens
uguugcaagucgguggagacgu

SEQ ID NO: 2395 - RNA, 22 nt, Homo sapiens
cucucuacugacuugcaacaua

SEQ ID NO: 2396 - RNA, 22 nt, Homo sapiens
ucucccuuccugcccuggcuag

SEQ ID NO: 2397 - RNA, 26 nt, Homo sapiens
cccagggcuuggaguggggcaagguu

SEQ ID NO: 2398 - RNA, 23 nt, Homo sapiens
uaucugcugggcuuucugguguu

SEQ ID NO: 2399 - RNA, 21 nt, Homo sapiens
uggcuguuggagggggcaggc

SEQ ID NO: 2400 - RNA, 22 nt, Homo sapiens
cagcccuccucccgcacccaaa

SEQ ID NO: 2401 - RNA, 22 nt, Homo sapiens
uaggggcagcagaggaccuggg

SEQ ID NO: 2402 - RNA, 22 nt, Homo sapiens
uugaggagacauggugggggcc

SEQ ID NO: 2403 - RNA, 21 nt, Homo sapiens
gcagcccagcugaggccucug

SEQ ID NO: 2404 - RNA, 22 nt, Homo sapiens
gagcaggcgaggcugggcugaa

SEQ ID NO: 2405 - RNA, 23 nt, Homo sapiens
ccagccacggacugagagugcau

SEQ ID NO: 2406 - RNA, 23 nt, Homo sapiens
guccuccaggccaugagcugcgg

SEQ ID NO: 2407 - RNA, 22 nt, Homo sapiens
ucaggcaguguggguaucagau

SEQ ID NO: 2408 - RNA, 23 nt, Homo sapiens
ugagaguggaauucacaguauuu

SEQ ID NO: 2409 - RNA, 23 nt, Homo sapiens
auacugugaauuucacugucaca

SEQ ID NO: 2410 - RNA, 21 nt, Homo sapiens
caaauggacaggauaacaccu

SEQ ID NO: 2411 - RNA, 22 nt, Homo sapiens
agguguuauccuauccauuugc

SEQ ID NO: 2412 - RNA, 22 nt, Homo sapiens
ugaucucaccgcugccuccuuc

SEQ ID NO: 2413 - RNA, 22 nt, Homo sapiens
caggaggcagugggcgagcagg

SEQ ID NO: 2414 - RNA, 22 nt, Homo sapiens
ugcaagacggauacugucaucu

SEQ ID NO: 2415 - RNA, 24 nt, Homo sapiens
ugucagugacuccugccccuuggu

SEQ ID NO: 2416 - RNA, 22 nt, Homo sapiens
agggggcgcagucacugacgug

SEQ ID NO: 2417 - RNA, 23 nt, Homo sapiens
ucaaaauguagaggaagacccca

SEQ ID NO: 2418 - RNA, 22 nt, Homo sapiens
aauuuacucugcaaucuucucc

SEQ ID NO: 2419 - RNA, 22 nt, Homo sapiens
agaagauugcagaguaaguucc

SEQ ID NO: 2420 - RNA, 26 nt, Homo sapiens
cacaggacugacuccucaccccagug

SEQ ID NO: 2421 - RNA, 22 nt, Homo sapiens
ucuggggaugaggacagugugu

SEQ ID NO: 2422 - RNA, 20 nt, Homo sapiens
augggugauggguguggugu

SEQ ID NO: 2423 - RNA, 22 nt, Homo sapiens
uuggccaccacaccuaccccuu

SEQ ID NO: 2424 - RNA, 22 nt, Homo sapiens
uguaguuguauuguauugccac

SEQ ID NO: 2425 - RNA, 23 nt, Homo sapiens
uagcaauacaguacaaauauagu

SEQ ID NO: 2426 - RNA, 22 nt, Homo sapiens
ucagucacauaucuagugucua

SEQ ID NO: 2427 - RNA, 22 nt, Homo sapiens
gacacuaggcaugugagugauu

SEQ ID NO: 2428 - RNA, 22 nt, Homo sapiens
ucaaucacuugguaauugcugu

SEQ ID NO: 2429 - RNA, 25 nt, Homo sapiens
agcggggaggaagugggcgcugcuu

SEQ ID NO: 2430 - RNA, 22 nt, Homo sapiens
agcccgccccagccgagguucu

SEQ ID NO: 2431 - RNA, 23 nt, Homo sapiens
gccccggcgcgggcggguucugg

SEQ ID NO: 2432 - RNA, 22 nt, Homo sapiens
agcaaggcggcaucucucugau

SEQ ID NO: 2433 - RNA, 21 nt, Homo sapiens
agagaugccgccuugcuccuu

SEQ ID NO: 2434 - RNA, 23 nt, Homo sapiens
uugaagaggaggugcucuguagc

SEQ ID NO: 2435 - RNA, 22 nt, Homo sapiens
acaacagugacuugcucuccaa

SEQ ID NO: 2436 - RNA, 18 nt, Homo sapiens
gggugagggcaggugguu

SEQ ID NO: 2437 - RNA, 18 nt, Homo sapiens
cgugucuucuggcuugau

SEQ ID NO: 2438 - RNA, 23 nt, Homo sapiens
ugcaucaggccagaagacaugag

SEQ ID NO: 2439 - RNA, 21 nt, Homo sapiens
aaugagagaccuguacuguau

SEQ ID NO: 2440 - RNA, 22 nt, Homo sapiens
uccaguacaggucucucauuuc

SEQ ID NO: 2441 - RNA, 22 nt, Homo sapiens
ugggauccagacagugggagaa

SEQ ID NO: 2442 - RNA, 22 nt, Homo sapiens
uucucccacuaccaggcuccca

SEQ ID NO: 2443 - RNA, 22 nt, Homo sapiens
ccaaccuagguggucagaguug

SEQ ID NO: 2444 - RNA, 22 nt, Homo sapiens
aacucugaccccuuagguugau

SEQ ID NO: 2445 - RNA, 23 nt, Homo sapiens
gugccaccuuaacugcagccaau

SEQ ID NO: 2446 - RNA, 22 nt, Homo sapiens
aaguuggcugcaguuaaggugg

SEQ ID NO: 2447 - RNA, 22 nt, Homo sapiens
aagggggaaggaaacauggaga

SEQ ID NO: 2448 - RNA, 22 nt, Homo sapiens
uccauguuuccuucccccuucu

SEQ ID NO: 2449 - RNA, 21 nt, Homo sapiens
acacauggguggcuguggccu

SEQ ID NO: 2450 - RNA, 22 nt, Homo sapiens
uaggccacagccacccaugugu

SEQ ID NO: 2451 - RNA, 21 nt, Homo sapiens
agcuguaccugaaaccaagca

SEQ ID NO: 2452 - RNA, 22 nt, Homo sapiens
ucacaaaucuauaauaugcagg

SEQ ID NO: 2453 - RNA, 21 nt, Homo sapiens
ugcuuaaguuguaccaaguau

SEQ ID NO: 2454 - RNA, 22 nt, Homo sapiens
ccuggcauauuugguauaacuu

SEQ ID NO: 2455 - RNA, 22 nt, Homo sapiens
ugagggcuccaggugacggugg

SEQ ID NO: 2456 - RNA, 22 nt, Homo sapiens
accugccagcaccucccugcag

SEQ ID NO: 2457 - RNA, 23 nt, Homo sapiens
ggcaggagggcugugccagguug

SEQ ID NO: 2458 - RNA, 22 nt, Homo sapiens
cccucucuggcuccuccccaaa

SEQ ID NO: 2459 - RNA, 24 nt, Homo sapiens
ugggggagccaugagauaagagca

SEQ ID NO: 2460 - RNA, 21 nt, Homo sapiens
guaccuucugguucagcuagu

SEQ ID NO: 2461 - RNA, 23 nt, Homo sapiens
aacugaaccaggagugagcuucg

SEQ ID NO: 2462 - RNA, 22 nt, Homo sapiens
uggggaaggcgucagugucggg

SEQ ID NO: 2463 - RNA, 21 nt, Homo sapiens
agacccugcagccuucccacc

SEQ ID NO: 2464 - RNA, 22 nt, Homo sapiens
acccagguucccucuggccgca

SEQ ID NO: 2465 - RNA, 23 nt, Homo sapiens
agggccagaggagccuggagugg

SEQ ID NO: 2466 - RNA, 22 nt, Homo sapiens
auagugggaagcuggcagauuc

SEQ ID NO: 2467 - RNA, 21 nt, Homo sapiens
aucugccagcuuccacagugg

SEQ ID NO: 2468 - RNA, 25 nt, Homo sapiens
caugcugaccucccuccugccccag

SEQ ID NO: 2469 - RNA, 23 nt, Homo sapiens
ugggaggggagaggcagcaagca

SEQ ID NO: 2470 - RNA, 22 nt, Homo sapiens
ucauuuaucuguugggaagcua

SEQ ID NO: 2471 - RNA, 23 nt, Homo sapiens
cuggcggagcccauuccaugcca

SEQ ID NO: 2472 - RNA, 22 nt, Homo sapiens
cacacaaguggcccccaacacu

SEQ ID NO: 2473 - RNA, 22 nt, Homo sapiens
ugcugggggccacaugagugug

SEQ ID NO: 2474 - RNA, 21 nt, Homo sapiens
gcccugaccuguccuguucug

SEQ ID NO: 2475 - RNA, 23 nt, Homo sapiens
uguagagcagggagcaggaagcu

SEQ ID NO: 2476 - RNA, 22 nt, Homo sapiens
ccaccaggucuagcauugggau

SEQ ID NO: 2477 - RNA, 22 nt, Homo sapiens
aaucccaaugcuagacccggug

SEQ ID NO: 2478 - RNA, 22 nt, Homo sapiens
gcugcgggcugcggucagggcg

SEQ ID NO: 2479 - RNA, 21 nt, Homo sapiens
aaaggugcucaaauuagacau

SEQ ID NO: 2480 - RNA, 22 nt, Homo sapiens
ccuaauuugaacaccuucggua

SEQ ID NO: 2481 - RNA, 19 nt, Homo sapiens
aggcagguuaucugggcug

SEQ ID NO: 2482 - RNA, 20 nt, Homo sapiens
augcgaggaugcugacagug

SEQ ID NO: 2483 - RNA, 22 nt, Homo sapiens
ugaaacuggagcgccuggagga

SEQ ID NO: 2484 - RNA, 22 nt, Homo sapiens
accagcgcguuuucaguuucau

SEQ ID NO: 2485 - RNA, 25 nt, Homo sapiens
aagggaggaggagcggaggggcccu

SEQ ID NO: 2486 - RNA, 22 nt, Homo sapiens
gcccgagaggauccgucccugc

SEQ ID NO: 2487 - RNA, 22 nt, Homo sapiens
aggacugauccucucgggcagg

SEQ ID NO: 2488 - RNA, 23 nt, Homo sapiens
cgggcuguccggaggggucggcu

SEQ ID NO: 2489 - RNA, 23 nt, Homo sapiens
ucuguauucuccuuugccugcag

SEQ ID NO: 2490 - RNA, 23 nt, Homo sapiens
ucaggcaaagggauauuuacaga

SEQ ID NO: 2491 - RNA, 21 nt, Homo sapiens
uuucugucuuuucugguccag

SEQ ID NO: 2492 - RNA, 23 nt, Homo sapiens
uggccggaugggacaggaggcau

SEQ ID NO: 2493 - RNA, 23 nt, Homo sapiens
ucuaaagacuagacuucgcuaug

SEQ ID NO: 2494 - RNA, 23 nt, Homo sapiens
uggcccggcgacgucucacgguc

SEQ ID NO: 2495 - RNA, 23 nt, Homo sapiens
ugaguggggcucccgggacggcg

SEQ ID NO: 2496 - RNA, 21 nt, Homo sapiens
agcggugcuccugcgggccga

SEQ ID NO: 2497 - RNA, 23 nt, Homo sapiens
ccggucccaggagaaccugcaga

SEQ ID NO: 2498 - RNA, 22 nt, Homo sapiens
aaggcccgggcuuuccucccag

SEQ ID NO: 2499 - RNA, 22 nt, Homo sapiens
agggaaggaggcuuggucuuag

SEQ ID NO: 2500 - RNA, 21 nt, Homo sapiens
gagguuuggggaggauuugcu

SEQ ID NO: 2501 - RNA, 20 nt, Homo sapiens
cgccccuccugcccccacag

SEQ ID NO: 2502 - RNA, 22 nt, Homo sapiens
ugcggggacaggccagggcauc

SEQ ID NO: 2503 - RNA, 22 nt, Homo sapiens
ccugacccacccccucccgcag

SEQ ID NO: 2504 - RNA, 22 nt, Homo sapiens
cucgggcggaggugguugagug

SEQ ID NO: 2505 - RNA, 24 nt, Homo sapiens
agaggacccguagcugcuagaagg

SEQ ID NO: 2506 - RNA, 22 nt, Homo sapiens
uuguggaucucaaggaugugcu

SEQ ID NO: 2507 - RNA, 22 nt, Homo sapiens
uucucuuucuuuagccuugugu

SEQ ID NO: 2508 - RNA, 22 nt, Homo sapiens
caaggccaaaggaagagaacag

SEQ ID NO: 2509 - RNA, 23 nt, Homo sapiens
augcggaccuggguuagcggagu

SEQ ID NO: 2510 - RNA, 22 nt, Homo sapiens
agccaggcucugaagggaaagu

SEQ ID NO: 2511 - RNA, 22 nt, Homo sapiens
uuucccuucagagccuggcuuu

SEQ ID NO: 2512 - RNA, 22 nt, Homo sapiens
ccagagaugguugccuuccuau

SEQ ID NO: 2513 - RNA, 23 nt, Homo sapiens
cagggaggcgcucacucucugcu

SEQ ID NO: 2514 - RNA, 22 nt, Homo sapiens
caugacgucacagaggcuucgc

SEQ ID NO: 2515 - RNA, 23 nt, Homo sapiens
aggccucugugacgucacggugu

SEQ ID NO: 2516 - RNA, 23 nt, Homo sapiens
ugccccaccugcugaccacccuc

SEQ ID NO: 2517 - RNA, 23 nt, Homo sapiens
gugagugggagccgguggggcug

SEQ ID NO: 2518 - RNA, 21 nt, Homo sapiens
uaggacuagauguuggaauua

SEQ ID NO: 2519 - RNA, 22 nt, Homo sapiens
aaauucauguucaaucuaaacc

SEQ ID NO: 2520 - RNA, 22 nt, Homo sapiens
uuuagauugaacaugaaguuag

SEQ ID NO: 2521 - RNA, 21 nt, Homo sapiens
gagggcaugcgcacuuugucc

SEQ ID NO: 2522 - RNA, 21 nt, Homo sapiens
acaaggugugcaugccugacc

SEQ ID NO: 2523 - RNA, 22 nt, Homo sapiens
cuucugaucaagauuuguggug

SEQ ID NO: 2524 - RNA, 21 nt, Homo sapiens
ccaaaucuugaucagaagccu

SEQ ID NO: 2525 - RNA, 24 nt, Homo sapiens
aggcaggggcuggugcugggcggg

SEQ ID NO: 2526 - RNA, 21 nt, Homo sapiens
cgccugcccagcccuccugcu

SEQ ID NO: 2527 - RNA, 22 nt, Homo sapiens
uuaacuccuuucacacccaugg

SEQ ID NO: 2528 - RNA, 21 nt, Homo sapiens
uggauguggaaggaguuaucu

SEQ ID NO: 2529 - RNA, 22 nt, Homo sapiens
ugagugauugauagcuauguuc

SEQ ID NO: 2530 - RNA, 21 nt, Homo sapiens
auagcaauugcucuuuuggaa

SEQ ID NO: 2531 - RNA, 21 nt, Homo sapiens
ucugaaagagcaguugguguu

SEQ ID NO: 2532 - RNA, 23 nt, Homo sapiens
cgcgggcgcuccuggccgccgcc

SEQ ID NO: 2533 - RNA, 20 nt, Homo sapiens
ccaggagauccagagagaau

SEQ ID NO: 2534 - RNA, 22 nt, Homo sapiens
auucucucuggaucccauggau

SEQ ID NO: 2535 - RNA, 22 nt, Homo sapiens
ucugccauccucccuccccuac

SEQ ID NO: 2536 - RNA, 24 nt, Homo sapiens
ggugggauggagagaagguaugag

SEQ ID NO: 2537 - RNA, 18 nt, Homo sapiens
ugagaugacacuguagcu

SEQ ID NO: 2538 - RNA, 21 nt, Homo sapiens
agcagacuugaccuacaauua

SEQ ID NO: 2539 - RNA, 22 nt, Homo sapiens
ccugcaacuuugccugaucaga

SEQ ID NO: 2540 - RNA, 22 nt, Homo sapiens
ugaucaggcaaaauugcagacu

SEQ ID NO: 2541 - RNA, 22 nt, Homo sapiens
cagaacaggagcauagaaaggc

SEQ ID NO: 2542 - RNA, 21 nt, Homo sapiens
auugccuaacaugugccagaa

SEQ ID NO: 2543 - RNA, 22 nt, Homo sapiens
ucugguauguaguagguaauaa

SEQ ID NO: 2544 - RNA, 22 nt, Homo sapiens
uuaauuuuuuguuucggucacu

SEQ ID NO: 2545 - RNA, 23 nt, Homo sapiens
cuugccauccugguccacugcau

SEQ ID NO: 2546 - RNA, 22 nt, Homo sapiens
guggaccaggauggcaagggcu

SEQ ID NO: 2547 - RNA, 22 nt, Homo sapiens
auaccucaucuagaaugcugua

SEQ ID NO: 2548 - RNA, 22 nt, Homo sapiens
uucuagaugagagauauauaua

SEQ ID NO: 2549 - RNA, 22 nt, Homo sapiens
ucuucuuccuuugcagaguuga

SEQ ID NO: 2550 - RNA, 22 nt, Homo sapiens
aauucuguaaaggaagaagagg

SEQ ID NO: 2551 - RNA, 22 nt, Homo sapiens
uaggagggaauaguaaaagcag

SEQ ID NO: 2552 - RNA, 22 nt, Homo sapiens
acccuugagccugaucccuagc

SEQ ID NO: 2553 - RNA, 22 nt, Homo sapiens
aauguuggaauccucgcuagag

SEQ ID NO: 2554 - RNA, 21 nt, Homo sapiens
uagcggggauuccaauauugg

SEQ ID NO: 2555 - RNA, 22 nt, Homo sapiens
ugauugucuucauaucuagaac

SEQ ID NO: 2556 - RNA, 22 nt, Homo sapiens
uucuggauaugaagacaaucaa

SEQ ID NO: 2557 - RNA, 23 nt, Homo sapiens
ccccgguguuggggcgcgucugc

SEQ ID NO: 2558 - RNA, 21 nt, Homo sapiens
ggcgcgcccagcucccgggcu

SEQ ID NO: 2559 - RNA, 20 nt, Homo sapiens
ugaggagaugcugggacuga

SEQ ID NO: 2560 - RNA, 21 nt, Homo sapiens
agagucggcgacgccgccagc

SEQ ID NO: 2561 - RNA, 22 nt, Homo sapiens
ugaagccagcucuggucugggc

SEQ ID NO: 2562 - RNA, 22 nt, Homo sapiens
ugagaccaggacuggaugcacc

SEQ ID NO: 2563 - RNA, 24 nt, Homo sapiens
gaugcgccgcccacugccccgcgc

SEQ ID NO: 2564 - RNA, 22 nt, Homo sapiens
gcggggguggcggcggcauccc

SEQ ID NO: 2565 - RNA, 22 nt, Homo sapiens
uuacggaccagcuaagggaggc

SEQ ID NO: 2566 - RNA, 21 nt, Homo sapiens
cacacauagcagguguauaua

SEQ ID NO: 2567 - RNA, 22 nt, Homo sapiens
guauacaccugauauguguaug

SEQ ID NO: 2568 - RNA, 22 nt, Homo sapiens
ugaaugguaaagcgaugucaca

SEQ ID NO: 2569 - RNA, 20 nt, Homo sapiens
aucgcuuuaccauucauguu

SEQ ID NO: 2570 - RNA, 18 nt, Homo sapiens
uggauaugaugacugaaa

SEQ ID NO: 2571 - RNA, 18 nt, Homo sapiens
cggugagcgcucgcuggc

SEQ ID NO: 2572 - RNA, 23 nt, Homo sapiens
ucugcacugugaguuggcuggcu

SEQ ID NO: 2573 - RNA, 24 nt, Homo sapiens
acauccugcuccacagggcagagg

SEQ ID NO: 2574 - RNA, 22 nt, Homo sapiens
ucuggcuaucucacgagacugu

SEQ ID NO: 2575 - RNA, 22 nt, Homo sapiens
auauuauuagccacuucuggau

SEQ ID NO: 2576 - RNA, 21 nt, Homo sapiens
agaaguggcuaauaauauuga

SEQ ID NO: 2577 - RNA, 22 nt, Homo sapiens
uaaaguggcagaguauagacac

SEQ ID NO: 2578 - RNA, 22 nt, Homo sapiens
ugucuauacucugucacuuuac

SEQ ID NO: 2579 - RNA, 21 nt, Homo sapiens
ucucaguaaguggcacucugu

SEQ ID NO: 2580 - RNA, 21 nt, Homo sapiens
gacagagugccacuuacugaa

SEQ ID NO: 2581 - RNA, 22 nt, Homo sapiens
aacucacgaaguauaccgaagu

SEQ ID NO: 2582 - RNA, 22 nt, Homo sapiens
uucgguauacuuugugaauugg

SEQ ID NO: 2583 - RNA, 22 nt, Homo sapiens
acuggcaugcugcauuuauaua

SEQ ID NO: 2584 - RNA, 22 nt, Homo sapiens
aucuaaaugcagcaugccaguc

SEQ ID NO: 2585 - RNA, 19 nt, Homo sapiens
cauccguccgucuguccac

SEQ ID NO: 2586 - RNA, 21 nt, Homo sapiens
aguggaccgaggaaggaagga

SEQ ID NO: 2587 - RNA, 22 nt, Homo sapiens
uacacaagaaaaccaaggcuca

SEQ ID NO: 2588 - RNA, 23 nt, Homo sapiens
uacauggauggaaaccuucaagc

SEQ ID NO: 2589 - RNA, 22 nt, Homo sapiens
uauggagguucuagaccauguu

SEQ ID NO: 2590 - RNA, 21 nt, Homo sapiens
uaacauaauaguguggauuga

SEQ ID NO: 2591 - RNA, 21 nt, Homo sapiens
ugcuuaaccuugcccucgaaa

SEQ ID NO: 2592 - RNA, 21 nt, Homo sapiens
uuggacgguaagguuaagcaa

SEQ ID NO: 2593 - RNA, 21 nt, Homo sapiens
ucacuccucuccucccgucuu

SEQ ID NO: 2594 - RNA, 22 nt, Homo sapiens
aagacgggaggaaagaagggag

SEQ ID NO: 2595 - RNA, 22 nt, Homo sapiens
ucaggcucaguccccucccgau

SEQ ID NO: 2596 - RNA, 22 nt, Homo sapiens
gucauacacggcucuccucucu

SEQ ID NO: 2597 - RNA, 22 nt, Homo sapiens
agaggcuggccgugaugaauuc

SEQ ID NO: 2598 - RNA, 21 nt, Homo sapiens
cggggcagcucaguacaggau

SEQ ID NO: 2599 - RNA, 22 nt, Homo sapiens
uccuguacugagcugccccgag

SEQ ID NO: 2600 - RNA, 22 nt, Homo sapiens
aaucauacagggacauccaguu

SEQ ID NO: 2601 - RNA, 22 nt, Homo sapiens
aaucguacagggucauccacuu

SEQ ID NO: 2602 - RNA, 21 nt, Homo sapiens
uugaaaggcuauuucuugguc

SEQ ID NO: 2603 - RNA, 21 nt, Homo sapiens
cccagauaauggcacucucaa

SEQ ID NO: 2604 - RNA, 22 nt, Homo sapiens
gugacaucacauauacggcagc

SEQ ID NO: 2605 - RNA, 22 nt, Homo sapiens
caaccuggaggacuccaugcug

SEQ ID NO: 2606 - RNA, 20 nt, Homo sapiens
ccauggaucuccaggugggu

SEQ ID NO: 2607 - RNA, 22 nt, Homo sapiens
cuuaugcaagauucccuucuac

SEQ ID NO: 2608 - RNA, 22 nt, Homo sapiens
aguggggaacccuuccaugagg

SEQ ID NO: 2609 - RNA, 23 nt, Homo sapiens
aggaccugcgggacaagauucuu

SEQ ID NO: 2610 - RNA, 22 nt, Homo sapiens
ugaaggucuacugugugccagg

SEQ ID NO: 2611 - RNA, 22 nt, Homo sapiens
uuguacaugguaggcuuucauu

SEQ ID NO: 2612 - RNA, 22 nt, Homo sapiens
ugaaacauacacgggaaaccuc

SEQ ID NO: 2613 - RNA, 22 nt, Homo sapiens
aaacaaacauggugcacuucuu

SEQ ID NO: 2614 - RNA, 22 nt, Homo sapiens
gaaguugcccauguuauuuucg

SEQ ID NO: 2615 - RNA, 22 nt, Homo sapiens
ugaguauuacauggccaaucuc

SEQ ID NO: 2616 - RNA, 22 nt, Homo sapiens
caaaccacacugugguguuaga

SEQ ID NO: 2617 - RNA, 21 nt, Homo sapiens
cagcagcacacugugguuugu

SEQ ID NO: 2618 - RNA, 23 nt, Homo sapiens
uuucaagccagggggcguuuuuc

SEQ ID NO: 2619 - RNA, 20 nt, Homo sapiens
ucacuaccugacaauacagu

SEQ ID NO: 2620 - RNA, 21 nt, Homo sapiens
ugcuguauugucagguaguga

SEQ ID NO: 2621 - RNA, 22 nt, Homo sapiens
aacaucacagcaagucugugcu

SEQ ID NO: 2622 - RNA, 21 nt, Homo sapiens
uuaagacuugcagugauguuu

SEQ ID NO: 2623 - RNA, 22 nt, Homo sapiens
aacaucacugcaagucuuaaca

SEQ ID NO: 2624 - RNA, 21 nt, Homo sapiens
acagacuugcugugauguuca

SEQ ID NO: 2625 - RNA, 22 nt, Homo sapiens
ucaggacacuucugaacuugga

SEQ ID NO: 2626 - RNA, 22 nt, Homo sapiens
caguucagaaguguuccugagu

SEQ ID NO: 2627 - RNA, 22 nt, Homo sapiens
uucugccucuguccagguccuu

SEQ ID NO: 2628 - RNA, 24 nt, Homo sapiens
agggcuggacucagcggcggagcu

SEQ ID NO: 2629 - RNA, 21 nt, Homo sapiens
ugacugccucacugaccacuu

SEQ ID NO: 2630 - RNA, 24 nt, Homo sapiens
aauuugguuucugaggcacuuagu

SEQ ID NO: 2631 - RNA, 21 nt, Homo sapiens
uacuuuucuagguuguugggg

SEQ ID NO: 2632 - RNA, 23 nt, Homo sapiens
ucacaacaaccuugcaggguaga

SEQ ID NO: 2633 - RNA, 22 nt, Homo sapiens
cuuggauuuuccugggccucag

SEQ ID NO: 2634 - RNA, 22 nt, Homo sapiens
ugaggacagggcaaauucacga

SEQ ID NO: 2635 - RNA, 21 nt, Homo sapiens
uuucccuuuccauccuggcag

SEQ ID NO: 2636 - RNA, 21 nt, Homo sapiens
uugccagggcaggagguggaa

SEQ ID NO: 2637 - RNA, 22 nt, Homo sapiens
aucauaugaaccaaacucuaau

SEQ ID NO: 2638 - RNA, 22 nt, Homo sapiens
uagagucuggcugauaugguuu

SEQ ID NO: 2639 - RNA, 21 nt, Homo sapiens
ccugugcucccagggccucgc

SEQ ID NO: 2640 - RNA, 22 nt, Homo sapiens
ugaggcccuuggggcacagugg

SEQ ID NO: 2641 - RNA, 22 nt, Homo sapiens
uccuaaaucugaaaguccaaaa

SEQ ID NO: 2642 - RNA, 24 nt, Homo sapiens
uuggacuuuuucagauuuggggau

SEQ ID NO: 2643 - RNA, 22 nt, Homo sapiens
augcaccugggcaaggauucug

SEQ ID NO: 2644 - RNA, 23 nt, Homo sapiens
uaauccuugcuaccugggugaga

SEQ ID NO: 2645 - RNA, 18 nt, Homo sapiens
aauccuugcuaccugggu

SEQ ID NO: 2646 - RNA, 22 nt, Homo sapiens
uuuugugucucccauuccccag

SEQ ID NO: 2647 - RNA, 22 nt, Homo sapiens
agggggauggcagagcaaaauu

SEQ ID NO: 2648 - RNA, 22 nt, Homo sapiens
gugcauggcuguauauauaaca

SEQ ID NO: 2649 - RNA, 21 nt, Homo sapiens
uauauauacagccaugcacuc

SEQ ID NO: 2650 - RNA, 22 nt, Homo sapiens
aaugcacccgggcaaggauucu

SEQ ID NO: 2651 - RNA, 22 nt, Homo sapiens
aauccuuugucccugggugaga

SEQ ID NO: 2652 - RNA, 22 nt, Homo sapiens
aaugcaccugggcaaggauuca

SEQ ID NO: 2653 - RNA, 21 nt, Homo sapiens
auccuugcuaucugggugcua

SEQ ID NO: 2654 - RNA, 23 nt, Homo sapiens
gggguauuguuuccgcugccagg

SEQ ID NO: 2655 - RNA, 23 nt, Homo sapiens
uagcagcgggaacaguucugcag

SEQ ID NO: 2656 - RNA, 22 nt, Homo sapiens
agacccuggucugcacucuauc

SEQ ID NO: 2657 - RNA, 21 nt, Homo sapiens
uugcagcugcgguuguaaggu

SEQ ID NO: 2658 - RNA, 22 nt, Homo sapiens
cgucaacacuugcugguuuccu

SEQ ID NO: 2659 - RNA, 22 nt, Homo sapiens
gggagccaggaaguauugaugu

SEQ ID NO: 2660 - RNA, 21 nt, Homo sapiens
uaaggcacccuucugaguaga

SEQ ID NO: 2661 - RNA, 22 nt, Homo sapiens
uauucaggaagguguuacuuaa

SEQ ID NO: 2662 - RNA, 21 nt, Homo sapiens
uuuugcaccuuuuggagugaa

SEQ ID NO: 2663 - RNA, 23 nt, Homo sapiens
ugauuguagccuuuuggaguaga

SEQ ID NO: 2664 - RNA, 23 nt, Homo sapiens
uacuccagagggcgucacucaug

SEQ ID NO: 2665 - RNA, 23 nt, Homo sapiens
ggguuuguagcuuugcuggcaug

SEQ ID NO: 2666 - RNA, 23 nt, Homo sapiens
cagggcucagggauuggauggag

SEQ ID NO: 2667 - RNA, 23 nt, Homo sapiens
augcuacucggaaaucccacuga

SEQ ID NO: 2668 - RNA, 21 nt, Homo sapiens
gugggauuucugaguagcauc

SEQ ID NO: 2669 - RNA, 23 nt, Homo sapiens
ccggggcagauugguguagggug

SEQ ID NO: 2670 - RNA, 23 nt, Homo sapiens
acggagacgacaagacugugcug

SEQ ID NO: 2671 - RNA, 22 nt, Homo sapiens
aauccacgcugagcuuggcauc

SEQ ID NO: 2672 - RNA, 23 nt, Homo sapiens
aggaaaugaggcuggcuaggagc

SEQ ID NO: 2673 - RNA, 22 nt, Homo sapiens
uacugcagacguggcaaucaug

SEQ ID NO: 2674 - RNA, 22 nt, Homo sapiens
ugauugguacgucuguggguag

SEQ ID NO: 2675 - RNA, 22 nt, Homo sapiens
aaucagugaaugccuugaaccu

SEQ ID NO: 2676 - RNA, 21 nt, Homo sapiens
uuacaggcgugaaccaccgcg

SEQ ID NO: 2677 - RNA, 21 nt, Homo sapiens
uacugcagacaguggcaauca

SEQ ID NO: 2678 - RNA, 21 nt, Homo sapiens
guuucaccauguuggucaggc

SEQ ID NO: 2679 - RNA, 22 nt, Homo sapiens
uacucaggagaguggcaaucac

SEQ ID NO: 2680 - RNA, 22 nt, Homo sapiens
uucagaucccagcggugccucu

SEQ ID NO: 2681 - RNA, 21 nt, Homo sapiens
gugucuuuugcucugcaguca

SEQ ID NO: 2682 - RNA, 22 nt, Homo sapiens
aagugcugucauagcugagguc

SEQ ID NO: 2683 - RNA, 23 nt, Homo sapiens
cacucagccuugagggcacuuuc

SEQ ID NO: 2684 - RNA, 23 nt, Homo sapiens
uaaauuucaccuuucugagaagg

SEQ ID NO: 2685 - RNA, 18 nt, Homo sapiens
uucacagggaggugucau

SEQ ID NO: 2686 - RNA, 22 nt, Homo sapiens
uucacaaggaggugucauuuau

SEQ ID NO: 2687 - RNA, 23 nt, Homo sapiens
uaaauuucaccuuucugagaaga

SEQ ID NO: 2688 - RNA, 22 nt, Homo sapiens
uucucaaggaggugucguuuau

SEQ ID NO: 2689 - RNA, 21 nt, Homo sapiens
auugacacuucugugaguaga

SEQ ID NO: 2690 - RNA, 23 nt, Homo sapiens
uacucuggagagugacaaucaug

SEQ ID NO: 2691 - RNA, 21 nt, Homo sapiens
auugacaccucugugagugga

SEQ ID NO: 2692 - RNA, 22 nt, Homo sapiens
uucucaagagggaggcaaucau

SEQ ID NO: 2693 - RNA, 22 nt, Homo sapiens
gagugccuucuuuuggagcguu

SEQ ID NO: 2694 - RNA, 24 nt, Homo sapiens
uucuccaaaagaaagcacuuucug

SEQ ID NO: 2695 - RNA, 18 nt, Homo sapiens
ugcuuccuuucagagggu

SEQ ID NO: 2696 - RNA, 23 nt, Homo sapiens
uucucgaggaaagaagcacuuuc

SEQ ID NO: 2697 - RNA, 18 nt, Homo sapiens
ugcuuccuuucagagggu

SEQ ID NO: 2698 - RNA, 22 nt, Homo sapiens
aucuggagguaagaagcacuuu

SEQ ID NO: 2699 - RNA, 22 nt, Homo sapiens
ccucuagauggaagcacugucu

SEQ ID NO: 2700 - RNA, 22 nt, Homo sapiens
aucgugcaucccuuuagagugu

SEQ ID NO: 2701 - RNA, 22 nt, Homo sapiens
aucgugcaucccuuuagagugu

SEQ ID NO: 2702 - RNA, 22 nt, Homo sapiens
aucgugcauccuuuuagagugu

SEQ ID NO: 2703 - RNA, 21 nt, Homo sapiens
agagauugguagaaaucaggu

SEQ ID NO: 2704 - RNA, 21 nt, Homo sapiens
acugaauccucuuuuccucag

SEQ ID NO: 2705 - RNA, 22 nt, Homo sapiens
ugggaugagggauugaagugga

SEQ ID NO: 2706 - RNA, 23 nt, Homo sapiens
aaucggacccauuuaaaccggag

SEQ ID NO: 2707 - RNA, 24 nt, Homo sapiens
ucugggcacaggcggauggacagg

SEQ ID NO: 2708 - RNA, 22 nt, Homo sapiens
gaaagcgcuucccuuugcugga

SEQ ID NO: 2709 - RNA, 20 nt, Homo sapiens
cugcaaagggaagcccuuuc

SEQ ID NO: 2710 - RNA, 22 nt, Homo sapiens
caaagcgcuccccuuuagaggu

SEQ ID NO: 2711 - RNA, 23 nt, Homo sapiens
caaagcgcuucucuuuagagugu

SEQ ID NO: 2712 - RNA, 23 nt, Homo sapiens
ucucuggagggaagcacuuucug

SEQ ID NO: 2713 - RNA, 21 nt, Homo sapiens
caaagcgcuucccuuuggagc

SEQ ID NO: 2714 - RNA, 22 nt, Homo sapiens
cucuagagggaagcacuuucug

SEQ ID NO: 2715 - RNA, 21 nt, Homo sapiens
aaagcgcuucccuucagagug

SEQ ID NO: 2716 - RNA, 22 nt, Homo sapiens
cucuagagggaagcgcuuucug

SEQ ID NO: 2717 - RNA, 21 nt, Homo sapiens
gaaagcgcuucucuuuagagg

SEQ ID NO: 2718 - RNA, 22 nt, Homo sapiens
cucuagagggaagcacuuucuc

SEQ ID NO: 2719 - RNA, 21 nt, Homo sapiens
ccagugacugagcuggagcca

SEQ ID NO: 2720 - RNA, 22 nt, Homo sapiens
aggauaggaagaaugaagugcu

SEQ ID NO: 2721 - RNA, 22 nt, Homo sapiens
aggagaguggauuccagguggu

SEQ ID NO: 2722 - RNA, 22 nt, Homo sapiens
uccuccucuaccucaucccagu

SEQ ID NO: 2723 - RNA, 22 nt, Homo sapiens
ugagggguuuggaaugggaugg

SEQ ID NO: 2724 - RNA, 21 nt, Homo sapiens
auccaguucucugagggggcu

SEQ ID NO: 2725 - RNA, 22 nt, Homo sapiens
aaccccuaaggcaacuggaugg

SEQ ID NO: 2726 - RNA, 21 nt, Homo sapiens
ucauccucgucucccucccag

SEQ ID NO: 2727 - RNA, 22 nt, Homo sapiens
agggaaggggacgaggguuggg

SEQ ID NO: 2728 - RNA, 23 nt, Homo sapiens
aagaagagacugagucaucgaau

SEQ ID NO: 2729 - RNA, 23 nt, Homo sapiens
caauggcacaaacucauucuuga

SEQ ID NO: 2730 - RNA, 22 nt, Homo sapiens
aaagugcauccuuuuagagugu

SEQ ID NO: 2731 - RNA, 22 nt, Homo sapiens
cucuagagggaagcgcuuucug

SEQ ID NO: 2732 - RNA, 22 nt, Homo sapiens
aaagugcauccuuuuagagguu

SEQ ID NO: 2733 - RNA, 22 nt, Homo sapiens
cucuagagggaagcgcuuucug

SEQ ID NO: 2734 - RNA, 22 nt, Homo sapiens
aaagugcaucuuuuuagaggau

SEQ ID NO: 2735 - RNA, 22 nt, Homo sapiens
cucuagagggaagcgcuuucug

SEQ ID NO: 2736 - RNA, 22 nt, Homo sapiens
caaagugccucccuuuagagug

SEQ ID NO: 2737 - RNA, 22 nt, Homo sapiens
aagugccuccuuuuagaguguu

SEQ ID NO: 2738 - RNA, 22 nt, Homo sapiens
uucuccaaaagggagcacuuuc

SEQ ID NO: 2739 - RNA, 22 nt, Homo sapiens
aaagugcuucccuuuggacugu

SEQ ID NO: 2740 - RNA, 21 nt, Homo sapiens
cuccagagggaaguacuuucu

SEQ ID NO: 2741 - RNA, 21 nt, Homo sapiens
aaagugcuuccuuuuagaggg

SEQ ID NO: 2742 - RNA, 22 nt, Homo sapiens
aaagugcuuccuuuuagagggu

SEQ ID NO: 2743 - RNA, 22 nt, Homo sapiens
cucuagagggaagcacuuucug

SEQ ID NO: 2744 - RNA, 22 nt, Homo sapiens
aaagugcuucucuuuggugggu

SEQ ID NO: 2745 - RNA, 20 nt, Homo sapiens
cuacaaagggaagcccuuuc

SEQ ID NO: 2746 - RNA, 21 nt, Homo sapiens
aaagugcuuccuuuuugaggg

SEQ ID NO: 2747 - RNA, 22 nt, Homo sapiens
aagugcuuccuuuuagaggguu

SEQ ID NO: 2748 - RNA, 24 nt, Homo sapiens
acaaagugcuucccuuuagagugu

SEQ ID NO: 2749 - RNA, 22 nt, Homo sapiens
acaaagugcuucccuuuagagu

SEQ ID NO: 2750 - RNA, 22 nt, Homo sapiens
aacgcacuucccuuuagagugu

SEQ ID NO: 2751 - RNA, 22 nt, Homo sapiens
aaaaugguucccuuuagagugu

SEQ ID NO: 2752 - RNA, 22 nt, Homo sapiens
cucuagagggaagcgcuuucug

SEQ ID NO: 2753 - RNA, 23 nt, Homo sapiens
gaacgcgcuucccuauagagggu

SEQ ID NO: 2754 - RNA, 22 nt, Homo sapiens
cucuagagggaagcgcuuucug

SEQ ID NO: 2755 - RNA, 21 nt, Homo sapiens
gaaggcgcuucccuuuggagu

SEQ ID NO: 2756 - RNA, 22 nt, Homo sapiens
cuacaaagggaagcacuuucuc

SEQ ID NO: 2757 - RNA, 22 nt, Homo sapiens
gaaggcgcuucccuuuagagcg

SEQ ID NO: 2758 - RNA, 21 nt, Homo sapiens
cuccagagggaugcacuuucu

SEQ ID NO: 2759 - RNA, 22 nt, Homo sapiens
cucuagagggaagcacuuucug

SEQ ID NO: 2760 - RNA, 22 nt, Homo sapiens
gaaagugcuuccuuuuagaggc

SEQ ID NO: 2761 - RNA, 23 nt, Homo sapiens
cucuugagggaagcacuuucugu

SEQ ID NO: 2762 - RNA, 20 nt, Homo sapiens
cugcaaagggaagcccuuuc

SEQ ID NO: 2763 - RNA, 22 nt, Homo sapiens
ccucccacacccaaggcuugca

SEQ ID NO: 2764 - RNA, 22 nt, Homo sapiens
caugccuugaguguaggaccgu

SEQ ID NO: 2765 - RNA, 22 nt, Homo sapiens
aucauacaaggacaauuucuuu

SEQ ID NO: 2766 - RNA, 22 nt, Homo sapiens
ggagaaauuauccuuggugugu

SEQ ID NO: 2767 - RNA, 22 nt, Homo sapiens
uggugggcacagaaucuggacu

SEQ ID NO: 2768 - RNA, 25 nt, Homo sapiens
aaaggauucugcugucggucccacu

SEQ ID NO: 2769 - RNA, 22 nt, Homo sapiens
ugugacagauugauaacugaaa

SEQ ID NO: 2770 - RNA, 23 nt, Homo sapiens
ucggggaucaucaugucacgaga

SEQ ID NO: 2771 - RNA, 22 nt, Homo sapiens
aaacauucgcggugcacuucuu

SEQ ID NO: 2772 - RNA, 22 nt, Homo sapiens
auucugcauuuuuagcaaguuc

SEQ ID NO: 2773 - RNA, 22 nt, Homo sapiens
accugagguugugcauuucuaa

SEQ ID NO: 2774 - RNA, 22 nt, Homo sapiens
ucagcaaacauuuauugugugc

SEQ ID NO: 2775 - RNA, 22 nt, Homo sapiens
ucaguaaauguuuauuagauga

SEQ ID NO: 2776 - RNA, 22 nt, Homo sapiens
agcuacaguuacuuuugcacca

SEQ ID NO: 2777 - RNA, 20 nt, Homo sapiens
uaaaaacugcaauuacuuuc

SEQ ID NO: 2778 - RNA, 23 nt, Homo sapiens
ugcaaaaguaauugcaguuuuug

SEQ ID NO: 2779 - RNA, 22 nt, Homo sapiens
agaaguaauugcgguuuugcca

SEQ ID NO: 2780 - RNA, 22 nt, Homo sapiens
caaaacuggcaauuacuuuugc

SEQ ID NO: 2781 - RNA, 22 nt, Homo sapiens
aaaaguaauugcgaguuuuacc

SEQ ID NO: 2782 - RNA, 25 nt, Homo sapiens
aaaaaccacaauuacuuuugcacca

SEQ ID NO: 2783 - RNA, 22 nt, Homo sapiens
aaaaguaauuguggauuuugcu

SEQ ID NO: 2784 - RNA, 22 nt, Homo sapiens
caaaaaccggcaauuacuuuug

SEQ ID NO: 2785 - RNA, 22 nt, Homo sapiens
gaaaacgacaaugacuuuugca

SEQ ID NO: 2786 - RNA, 21 nt, Homo sapiens
caaaaacugcaauuacuuuca

SEQ ID NO: 2787 - RNA, 21 nt, Homo sapiens
aaagguaauugugguuucugc

SEQ ID NO: 2788 - RNA, 22 nt, Homo sapiens
caaaaacugcaguuacuuuugc

SEQ ID NO: 2789 - RNA, 20 nt, Homo sapiens
aaaagugauugcaguguuug

SEQ ID NO: 2790 - RNA, 22 nt, Homo sapiens
aaagguaauugcaguuuuuccc

SEQ ID NO: 2791 - RNA, 21 nt, Homo sapiens
uaaaaacugcaauuacuuuua

SEQ ID NO: 2792 - RNA, 23 nt, Homo sapiens
ugcaaaaguaauugcaguuuuug

SEQ ID NO: 2793 - RNA, 21 nt, Homo sapiens
aaaaguaacugcgguuuuuga

SEQ ID NO: 2794 - RNA, 22 nt, Homo sapiens
aacggcaaugacuuuuguacca

SEQ ID NO: 2795 - RNA, 22 nt, Homo sapiens
caaaaacugcaguuacuuuugu

SEQ ID NO: 2796 - RNA, 22 nt, Homo sapiens
aaaaguaauugcgguuuuugcc

SEQ ID NO: 2797 - RNA, 20 nt, Homo sapiens
aaaaggcauugugguuuuug

SEQ ID NO: 2798 - RNA, 22 nt, Homo sapiens
aaagaccgugacuacuuuugca

SEQ ID NO: 2799 - RNA, 22 nt, Homo sapiens
agaaguaacuacgguuuuugca

SEQ ID NO: 2800 - RNA, 19 nt, Homo sapiens
aaaaaccacaauuacuuuu

SEQ ID NO: 2801 - RNA, 19 nt, Homo sapiens
aaaaguaauugcggucuuu

SEQ ID NO: 2802 - RNA, 22 nt, Homo sapiens
caaaaacugcaauuacuuuugc

SEQ ID NO: 2803 - RNA, 22 nt, Homo sapiens
gaaaguaauugcuguuuuugcc

SEQ ID NO: 2804 - RNA, 21 nt, Homo sapiens
uaaaacugcaguuauuuuugc

SEQ ID NO: 2805 - RNA, 21 nt, Homo sapiens
aaaaguaauugcaguuuuugc

SEQ ID NO: 2806 - RNA, 22 nt, Homo sapiens
uaaaacccacaauuauguuugu

SEQ ID NO: 2807 - RNA, 22 nt, Homo sapiens
aaaaguaauugcggguuuugcc

SEQ ID NO: 2808 - RNA, 21 nt, Homo sapiens
caaaaccgcaguaacuuuugu

SEQ ID NO: 2809 - RNA, 22 nt, Homo sapiens
aaaaguuauugcgguuuuggcu

SEQ ID NO: 2810 - RNA, 21 nt, Homo sapiens
uggcaguuacuuuugcaccag

SEQ ID NO: 2811 - RNA, 21 nt, Homo sapiens
aaaaguaauugcgguuuuugc

SEQ ID NO: 2812 - RNA, 20 nt, Homo sapiens
aaaacugcaguuacuuuugc

SEQ ID NO: 2813 - RNA, 18 nt, Homo sapiens
aaaaguacuugcggauuu

SEQ ID NO: 2814 - RNA, 20 nt, Homo sapiens
gugcaaaagucaucacgguu

SEQ ID NO: 2815 - RNA, 22 nt, Homo sapiens
caaaaccgcgauuacucuugca

SEQ ID NO: 2816 - RNA, 21 nt, Homo sapiens
aaaaguaauugugguuuuugc

SEQ ID NO: 2817 - RNA, 21 nt, Homo sapiens
aaaaacugcaaucacuuuugc

SEQ ID NO: 2818 - RNA, 22 nt, Homo sapiens
caaaagugauugugguuuuugc

SEQ ID NO: 2819 - RNA, 22 nt, Homo sapiens
caagaaccucaguugcuuuugu

SEQ ID NO: 2820 - RNA, 22 nt, Homo sapiens
aaaaguaauugugguuuuggcc

SEQ ID NO: 2821 - RNA, 22 nt, Homo sapiens
caaaaaucucaauuacuuuugc

SEQ ID NO: 2822 - RNA, 22 nt, Homo sapiens
aaaaguaauugcgguuuuugcc

SEQ ID NO: 2823 - RNA, 22 nt, Homo sapiens
caaaaaccacaguuucuuuugc

SEQ ID NO: 2824 - RNA, 22 nt, Homo sapiens
aaaaguaauugugguuuuugcc

SEQ ID NO: 2825 - RNA, 22 nt, Homo sapiens
aaaaacugagacuacuuuugca

SEQ ID NO: 2826 - RNA, 19 nt, Homo sapiens
aaaaacuguaauuacuuuu

SEQ ID NO: 2827 - RNA, 22 nt, Homo sapiens
aaaacuguaauuacuuuuguac

SEQ ID NO: 2828 - RNA, 23 nt, Homo sapiens
ugcaaaaguaauugcaguuuuug

SEQ ID NO: 2829 - RNA, 23 nt, Homo sapiens
caaaaaccgcaauuacuuuugca

SEQ ID NO: 2830 - RNA, 22 nt, Homo sapiens
aaaaguaaucgcgguuuuuguc

SEQ ID NO: 2831 - RNA, 22 nt, Homo sapiens
aaaaguaauugcggauuuugcc

SEQ ID NO: 2832 - RNA, 22 nt, Homo sapiens
aaaaguaauugcggucuuuggu

SEQ ID NO: 2833 - RNA, 22 nt, Homo sapiens
aaaaguacuugcggauuuugcu

SEQ ID NO: 2834 - RNA, 22 nt, Homo sapiens
aaaaguauuugcggguuuuguc

SEQ ID NO: 2835 - RNA, 21 nt, Homo sapiens
caaagguauuugugguuuuug

SEQ ID NO: 2836 - RNA, 22 nt, Homo sapiens
caaaaguaauuguggauuuugu

SEQ ID NO: 2837 - RNA, 22 nt, Homo sapiens
ccaaaacugcaguuacuuuugc

SEQ ID NO: 2838 - RNA, 22 nt, Homo sapiens
aaaaguaauugcgguuuuugcc

SEQ ID NO: 2839 - RNA, 22 nt, Homo sapiens
uagcaaaaacugcaguuacuuu

SEQ ID NO: 2840 - RNA, 22 nt, Homo sapiens
gcuggugcaaaaguaauggcgg

SEQ ID NO: 2841 - RNA, 23 nt, Homo sapiens
auggccaaaacugcaguuauuuu

SEQ ID NO: 2842 - RNA, 25 nt, Homo sapiens
aaaaaccacaauuacuuuugcacca

SEQ ID NO: 2843 - RNA, 21 nt, Homo sapiens
caaaagugaucgugguuuuug

SEQ ID NO: 2844 - RNA, 23 nt, Homo sapiens
caaagacugcaauuacuuuugcg

SEQ ID NO: 2845 - RNA, 23 nt, Homo sapiens
aaaaguaacugcgguuuuugccu

SEQ ID NO: 2846 - RNA, 22 nt, Homo sapiens
aaaaguaaucacuguuuuugcc

SEQ ID NO: 2847 - RNA, 23 nt, Homo sapiens
caaaaaccgcaauuacuuuugca

SEQ ID NO: 2848 - RNA, 21 nt, Homo sapiens
ugacaacuauggaugagcucu

SEQ ID NO: 2849 - RNA, 20 nt, Homo sapiens
agugccugagggaguaagag

SEQ ID NO: 2850 - RNA, 22 nt, Homo sapiens
ugucuuacucccucaggcacau

SEQ ID NO: 2851 - RNA, 23 nt, Homo sapiens
agugccugagggaguaagagccc

SEQ ID NO: 2852 - RNA, 22 nt, Homo sapiens
augugccugagggaguaagaca

SEQ ID NO: 2853 - RNA, 20 nt, Homo sapiens
ucuuacucccucaggcacug

SEQ ID NO: 2854 - RNA, 21 nt, Homo sapiens
gcgacccacucuugguuucca

SEQ ID NO: 2855 - RNA, 21 nt, Homo sapiens
gcgacccauacuugguuucag

SEQ ID NO: 2856 - RNA, 22 nt, Homo sapiens
gaaaucaagcgugggugagacc

SEQ ID NO: 2857 - RNA, 21 nt, Homo sapiens
aacaggugacugguuagacaa

SEQ ID NO: 2858 - RNA, 21 nt, Homo sapiens
aaaacggugagauuuuguuuu

SEQ ID NO: 2859 - RNA, 21 nt, Homo sapiens
gcuaguccugacucagccagu

SEQ ID NO: 2860 - RNA, 21 nt, Homo sapiens
aggguaagcugaaccucugau

SEQ ID NO: 2861 - RNA, 22 nt, Homo sapiens
auauuaccauuagcucaucuuu

SEQ ID NO: 2862 - RNA, 22 nt, Homo sapiens
gaugagcucauuguaauaugag

SEQ ID NO: 2863 - RNA, 23 nt, Homo sapiens
guuugcacgggugggccuugucu

SEQ ID NO: 2864 - RNA, 19 nt, Homo sapiens
guccuaggaggcuccucug

SEQ ID NO: 2865 - RNA, 21 nt, Homo sapiens
caauucucaaaggagccuccc

SEQ ID NO: 2866 - RNA, 21 nt, Homo sapiens
guuggggugcaggggucugcu

SEQ ID NO: 2867 - RNA, 22 nt, Homo sapiens
uuagcuuaaggaguaccagauc

SEQ ID NO: 2868 - RNA, 21 nt, Homo sapiens
uaugguacuccuuaagcuaac

SEQ ID NO: 2869 - RNA, 19 nt, Homo sapiens
ugagcugcuguaccaaaau

SEQ ID NO: 2870 - RNA, 22 nt, Homo sapiens
cacauaugaagugagccagcac

SEQ ID NO: 2871 - RNA, 22 nt, Homo sapiens
ugcuggcucauuucauaugugu

SEQ ID NO: 2872 - RNA, 22 nt, Homo sapiens
uuccaugccuccuagaaguucc

SEQ ID NO: 2873 - RNA, 22 nt, Homo sapiens
agccuuccaggagaaauggaga

SEQ ID NO: 2874 - RNA, 22 nt, Homo sapiens
uaaaacuuuaagugugccuagg

SEQ ID NO: 2875 - RNA, 22 nt, Homo sapiens
uaggcacacuuaaaguuauagc

SEQ ID NO: 2876 - RNA, 22 nt, Homo sapiens
gaauauggguauauuaguuugg

SEQ ID NO: 2877 - RNA, 22 nt, Homo sapiens
aaacuaauauacccauauucug

SEQ ID NO: 2878 - RNA, 22 nt, Homo sapiens
uaguucuucccuuugcccaauu

SEQ ID NO: 2879 - RNA, 22 nt, Homo sapiens
cagggaaaugggaagaacuaga

SEQ ID NO: 2880 - RNA, 22 nt, Homo sapiens
cugaauagcugggacuacaggu

SEQ ID NO: 2881 - RNA, 22 nt, Homo sapiens
ugaaguaccagcuacucgagag

SEQ ID NO: 2882 - RNA, 22 nt, Homo sapiens
cagagugacaagcugguuaaag

SEQ ID NO: 2883 - RNA, 22 nt, Homo sapiens
uauccagcuuguuacuauaugc

SEQ ID NO: 2884 - RNA, 21 nt, Homo sapiens
gccccgggcagugugaucauc

SEQ ID NO: 2885 - RNA, 18 nt, Homo sapiens
auggucaccuccgggacu

SEQ ID NO: 2886 - RNA, 19 nt, Homo sapiens
aagucccacuaaugccagc

SEQ ID NO: 2887 - RNA, 21 nt, Homo sapiens
acuggcauuagugggacuuuu

SEQ ID NO: 2888 - RNA, 23 nt, Homo sapiens
ugcacauggcaaccuagcuccca

SEQ ID NO: 2889 - RNA, 21 nt, Homo sapiens
ggcugggugcucuugugcagu

SEQ ID NO: 2890 - RNA, 21 nt, Homo sapiens
uaaaguaaauaugcaccaaaa

SEQ ID NO: 2891 - RNA, 21 nt, Homo sapiens
aauaaaguucauguauggcaa

SEQ ID NO: 2892 - RNA, 21 nt, Homo sapiens
uugccauacauagacuuuauu

SEQ ID NO: 2893 - RNA, 21 nt, Homo sapiens
auacccauagcuuagcuccca

SEQ ID NO: 2894 - RNA, 21 nt, Homo sapiens
ugggagcuaagcuauggguau

SEQ ID NO: 2895 - RNA, 22 nt, Homo sapiens
caaaguuuaagauccuugaagu

SEQ ID NO: 2896 - RNA, 22 nt, Homo sapiens
aucaaggaucuuaaacuuugcc

SEQ ID NO: 2897 - RNA, 20 nt, Homo sapiens
aaaguagcuguaccauuugc

SEQ ID NO: 2898 - RNA, 19 nt, Homo sapiens
agguugacauacguuuccc

SEQ ID NO: 2899 - RNA, 19 nt, Homo sapiens
aggcacggugucagcaggc

SEQ ID NO: 2900 - RNA, 19 nt, Homo sapiens
gggcgccugugaucccaac

SEQ ID NO: 2901 - RNA, 23 nt, Homo sapiens
aguauguucuuccaggacagaac

SEQ ID NO: 2902 - RNA, 20 nt, Homo sapiens
auguauaaauguauacacac

SEQ ID NO: 2903 - RNA, 22 nt, Homo sapiens
gagaaaugcuggacuaaucugc

SEQ ID NO: 2904 - RNA, 22 nt, Homo sapiens
agaaaggguggcaauaccucuu

SEQ ID NO: 2905 - RNA, 22 nt, Homo sapiens
agguauugccacccuuucuagu

SEQ ID NO: 2906 - RNA, 22 nt, Homo sapiens
guagcaccuugcaggauaaggu

SEQ ID NO: 2907 - RNA, 24 nt, Homo sapiens
uacagaugcagauucucugacuuc

SEQ ID NO: 2908 - RNA, 20 nt, Homo sapiens
aacucuagccugagcaacag

SEQ ID NO: 2909 - RNA, 22 nt, Homo sapiens
acagcccagcaguuaucacggg

SEQ ID NO: 2910 - RNA, 21 nt, Homo sapiens
uaucguaucguauuguauugu

SEQ ID NO: 2911 - RNA, 22 nt, Homo sapiens
uuagaacguuuuagggucaaau

SEQ ID NO: 2912 - RNA, 22 nt, Homo sapiens
uaacaaacaccuguaaaacagc

SEQ ID NO: 2913 - RNA, 22 nt, Homo sapiens
agcauacaccuguaguccuaga

SEQ ID NO: 2914 - RNA, 21 nt, Homo sapiens
aguuaaugaauccuggaaagu

SEQ ID NO: 2915 - RNA, 21 nt, Homo sapiens
ucagcuacuaccucuauuagg

SEQ ID NO: 2916 - RNA, 22 nt, Homo sapiens
uugcucugagcuccgagaaagc

SEQ ID NO: 2917 - RNA, 22 nt, Homo sapiens
caaauaauaccacagugggugu

SEQ ID NO: 2918 - RNA, 20 nt, Homo sapiens
aauaauaucacaguaggugu

SEQ ID NO: 2919 - RNA, 22 nt, Homo sapiens
aauaauaucacaguagguguac

SEQ ID NO: 2920 - RNA, 22 nt, Homo sapiens
gcaguggcucugaaaugaacuc

SEQ ID NO: 2921 - RNA, 21 nt, Homo sapiens
cagaucaugggacugucucag

SEQ ID NO: 2922 - RNA, 22 nt, Homo sapiens
acuccaagaagaaucuagacag

SEQ ID NO: 2923 - RNA, 22 nt, Homo sapiens
cucauuuaaguagucugaugcc

SEQ ID NO: 2924 - RNA, 22 nt, Homo sapiens
ucaaguaguuucaugauaaagg

SEQ ID NO: 2925 - RNA, 22 nt, Homo sapiens
ugggggagugcagugauugugg

SEQ ID NO: 2926 - RNA, 22 nt, Homo sapiens
uccugucuuuccuuguuggagc

SEQ ID NO: 2927 - RNA, 22 nt, Homo sapiens
uaaugcauuaaauuauugaagg

SEQ ID NO: 2928 - RNA, 19 nt, Homo sapiens
uuauugucacguucugauu

SEQ ID NO: 2929 - RNA, 22 nt, Homo sapiens
ugagucagcaacauaucccaug

SEQ ID NO: 2930 - RNA, 18 nt, Homo sapiens
aggagaagucgggaaggu

SEQ ID NO: 2931 - RNA, 22 nt, Homo sapiens
cgaaaacagcaauuaccuuugc

SEQ ID NO: 2932 - RNA, 22 nt, Homo sapiens
uuaggccaucaucccauuaugc

SEQ ID NO: 2933 - RNA, 23 nt, Homo sapiens
uguuucggggcucauggccugug

SEQ ID NO: 2934 - RNA, 22 nt, Homo sapiens
aaagguaauugcaguuuuuccc

SEQ ID NO: 2935 - RNA, 22 nt, Homo sapiens
uucuggauaacaugcugaagcu

SEQ ID NO: 2936 - RNA, 22 nt, Homo sapiens
acguuugaaugcuguacaaggc

SEQ ID NO: 2937 - RNA, 20 nt, Homo sapiens
augagcgacugugccugacc

SEQ ID NO: 2938 - RNA, 21 nt, Homo sapiens
ugaguuggccaucugagugag

SEQ ID NO: 2939 - RNA, 20 nt, Homo sapiens
guccgcucggcgguggccca

SEQ ID NO: 2940 - RNA, 24 nt, Homo sapiens
cugaagugauguguaacugaucag

SEQ ID NO: 2941 - RNA, 20 nt, Homo sapiens
gcggagagagaauggggagc

SEQ ID NO: 2942 - RNA, 22 nt, Homo sapiens
cacgcucaugcacacacccaca

SEQ ID NO: 2943 - RNA, 23 nt, Homo sapiens
ugagugugugugugugagugugu

SEQ ID NO: 2944 - RNA, 19 nt, Homo sapiens
gagccaguuggacaggagc

SEQ ID NO: 2945 - RNA, 22 nt, Homo sapiens
aagauguggaaaaauuggaauc

SEQ ID NO: 2946 - RNA, 22 nt, Homo sapiens
auucuaauuucuccacgucuuu

SEQ ID NO: 2947 - RNA, 21 nt, Homo sapiens
uagauaaaauauugguaccug

SEQ ID NO: 2948 - RNA, 21 nt, Homo sapiens
cuucuugugcucuaggauugu

SEQ ID NO: 2949 - RNA, 20 nt, Homo sapiens
gggcuggggcgcggggaggu

SEQ ID NO: 2950 - RNA, 23 nt, Homo sapiens
uucauuugguauaaaccgcgauu

SEQ ID NO: 2951 - RNA, 22 nt, Homo sapiens
uugagaaugaugaaucauuagg

SEQ ID NO: 2952 - RNA, 21 nt, Homo sapiens
ucuuguguucucuagaucagu

SEQ ID NO: 2953 - RNA, 22 nt, Homo sapiens
uaacugguugaacaacugaacc

SEQ ID NO: 2954 - RNA, 23 nt, Homo sapiens
uuacaguuguucaaccaguuacu

SEQ ID NO: 2955 - RNA, 21 nt, Homo sapiens
caaagaggaaggucccauuac

SEQ ID NO: 2956 - RNA, 22 nt, Homo sapiens
ucaguuccaggccaaccaggcu

SEQ ID NO: 2957 - RNA, 22 nt, Homo sapiens
uuaugguuugccugggacugag

SEQ ID NO: 2958 - RNA, 19 nt, Homo sapiens
ugggcguaucuguaugcua

SEQ ID NO: 2959 - RNA, 22 nt, Homo sapiens
uaugcauuguauuuuuaggucc

SEQ ID NO: 2960 - RNA, 21 nt, Homo sapiens
uuuccauaggugaugagucac

SEQ ID NO: 2961 - RNA, 21 nt, Homo sapiens
uuggccacaauggguuagaac

SEQ ID NO: 2962 - RNA, 24 nt, Homo sapiens
ucagaacaaaugccgguucccaga

SEQ ID NO: 2963 - RNA, 22 nt, Homo sapiens
ugagaaccacgucugcucugag

SEQ ID NO: 2964 - RNA, 21 nt, Homo sapiens
uaauuuuauguauaagcuagu

SEQ ID NO: 2965 - RNA, 22 nt, Homo sapiens
gagcuuauucauaaaagugcag

SEQ ID NO: 2966 - RNA, 20 nt, Homo sapiens
agaccauggguucucauugu

SEQ ID NO: 2967 - RNA, 22 nt, Homo sapiens
uugugucaauaugcgaugaugu

SEQ ID NO: 2968 - RNA, 19 nt, Homo sapiens
ugucucugcugggguuucu

SEQ ID NO: 2969 - RNA, 25 nt, Homo sapiens
aggcaccagccaggcauugcucagc

SEQ ID NO: 2970 - RNA, 21 nt, Homo sapiens
gaagugugccguggugugucu

SEQ ID NO: 2971 - RNA, 21 nt, Homo sapiens
aagccugcccggcuccucggg

SEQ ID NO: 2972 - RNA, 22 nt, Homo sapiens
ugugucacucgaugaccacugu

SEQ ID NO: 2973 - RNA, 22 nt, Homo sapiens
uacgucaucguugucaucguca

SEQ ID NO: 2974 - RNA, 20 nt, Homo sapiens
guugugucaguuuaucaaac

SEQ ID NO: 2975 - RNA, 23 nt, Homo sapiens
acuuacagacaagagccuugcuc

SEQ ID NO: 2976 - RNA, 22 nt, Homo sapiens
uggucuaggauuguuggaggag

SEQ ID NO: 2977 - RNA, 23 nt, Homo sapiens
gacacgggcgacagcugcggccc

SEQ ID NO: 2978 - RNA, 22 nt, Homo sapiens
cacacacugcaauuacuuuugc

SEQ ID NO: 2979 - RNA, 19 nt, Homo sapiens
aggcugcggaauucaggac

SEQ ID NO: 2980 - RNA, 23 nt, Homo sapiens
uaaaucccauggugccuucuccu

SEQ ID NO: 2981 - RNA, 21 nt, Homo sapiens
aaacuacugaaaaucaaagau

SEQ ID NO: 2982 - RNA, 21 nt, Homo sapiens
ccugcgagucuccggcggugg

SEQ ID NO: 2983 - RNA, 21 nt, Homo sapiens
gggcuagggccugcugccccc

SEQ ID NO: 2984 - RNA, 21 nt, Homo sapiens
guucaaauccagaucuauaac

SEQ ID NO: 2985 - RNA, 19 nt, Homo sapiens
ccgguuccagucccuggag

SEQ ID NO: 2986 - RNA, 19 nt, Homo sapiens
uucugcugccggccaaggc

SEQ ID NO: 2987 - RNA, 22 nt, Homo sapiens
uccucaucacacugcaccuuag

SEQ ID NO: 2988 - RNA, 20 nt, Homo sapiens
gguagugaguuaucagcuac

SEQ ID NO: 2989 - RNA, 20 nt, Homo sapiens
gauauucagaggcuaggugg

SEQ ID NO: 2990 - RNA, 21 nt, Homo sapiens
acggcccaggcggcauuggug

SEQ ID NO: 2991 - RNA, 21 nt, Homo sapiens
agcaugacagaggagaggugg

SEQ ID NO: 2992 - RNA, 21 nt, Homo sapiens
gggaagagcuguacggccuuc

SEQ ID NO: 2993 - RNA, 19 nt, Homo sapiens
ccgccugagcuagcugugg

SEQ ID NO: 2994 - RNA, 24 nt, Homo sapiens
uuggaagcuuggaccaacuagcug

SEQ ID NO: 2995 - RNA, 25 nt, Homo sapiens
aggggugguguugggacagcuccgu

SEQ ID NO: 2996 - RNA, 19 nt, Homo sapiens
ucuagugcgggcguucccg

SEQ ID NO: 2997 - RNA, 24 nt, Homo sapiens
aggagcagugccggccaaggcgcc

SEQ ID NO: 2998 - RNA, 19 nt, Homo sapiens
gaauacgucugguugaucc

SEQ ID NO: 2999 - RNA, 20 nt, Homo sapiens
cuuauaucagaggcuguggg

SEQ ID NO: 3000 - RNA, 20 nt, Homo sapiens
uuccgccagucgguggccgg

SEQ ID NO: 3001 - RNA, 19 nt, Homo sapiens
aaggggcugggggagcaca

SEQ ID NO: 3002 - RNA, 20 nt, Homo sapiens
ggagguugggaagggcagag

SEQ ID NO: 3003 - RNA, 18 nt, Homo sapiens
ugaggcgggggggcgagc

SEQ ID NO: 3004 - RNA, 20 nt, Homo sapiens
agagaugaagcgggggggcg

SEQ ID NO: 3005 - RNA, 24 nt, Homo sapiens
ggaggccgggguggggcggggcgg

SEQ ID NO: 3006 - RNA, 20 nt, Homo sapiens
aggguguuucucucaucucu

SEQ ID NO: 3007 - RNA, 19 nt, Homo sapiens
ggggagcgaggggcggggc

SEQ ID NO: 3008 - RNA, 21 nt, Homo sapiens
ugagcuaaaugugugcuggga

SEQ ID NO: 3009 - RNA, 23 nt, Homo sapiens
gcgaggaccccucggggucugac

SEQ ID NO: 3010 - RNA, 25 nt, Homo sapiens
gcugggcagggcuucugagcuccuu

SEQ ID NO: 3011 - RNA, 20 nt, Homo sapiens
gggaaaaggaagggggagga

SEQ ID NO: 3012 - RNA, 20 nt, Homo sapiens
gcggaaggcggagcggcgga

SEQ ID NO: 3013 - RNA, 18 nt, Homo sapiens
gugaaggcccggcggaga

SEQ ID NO: 3014 - RNA, 19 nt, Homo sapiens
ugagggagugggugggagg

SEQ ID NO: 3015 - RNA, 19 nt, Homo sapiens
acuggaauuggagucaaaa

SEQ ID NO: 3016 - RNA, 19 nt, Homo sapiens
ugagggaguuggguguaua

SEQ ID NO: 3017 - RNA, 20 nt, Homo sapiens
aggaauguuccuucuuugcc

SEQ ID NO: 3018 - RNA, 19 nt, Homo sapiens
ugagggaguggauuguaug

SEQ ID NO: 3019 - RNA, 19 nt, Homo sapiens
ggcuggucagaugggagug

SEQ ID NO: 3020 - RNA, 19 nt, Homo sapiens
agcagggcuggggauugca

SEQ ID NO: 3021 - RNA, 19 nt, Homo sapiens
ugagggaggagguugggua

SEQ ID NO: 3022 - RNA, 19 nt, Homo sapiens
ugaggugguaggauguaga

SEQ ID NO: 3023 - RNA, 23 nt, Homo sapiens
gaacgccuguucuugccaggugg

SEQ ID NO: 3024 - RNA, 22 nt, Homo sapiens
uccgagccugggucucccucuu

SEQ ID NO: 3025 - RNA, 22 nt, Homo sapiens
ggggguccccggugcucggauc

SEQ ID NO: 3026 - RNA, 22 nt, Homo sapiens
agucauuggaggguuugagcag

SEQ ID NO: 3027 - RNA, 19 nt, Homo sapiens
cagcaggaggugaggggag

SEQ ID NO: 3028 - RNA, 22 nt, Homo sapiens
acucaaaacccuucagugacuu

SEQ ID NO: 3029 - RNA, 22 nt, Homo sapiens
agacuucccauuugaagguggc

SEQ ID NO: 3030 - RNA, 23 nt, Homo sapiens
aaacucuacuuguccuucugagu

SEQ ID NO: 3031 - RNA, 24 nt, Homo sapiens
gaccuggacauguuugugcccagu

SEQ ID NO: 3032 - RNA, 20 nt, Homo sapiens
auggagauagauauagaaau

SEQ ID NO: 3033 - RNA, 21 nt, Homo sapiens
ggcuagcaacagcgcuuaccu

SEQ ID NO: 3034 - RNA, 21 nt, Homo sapiens
acagucugcugagguuggagc

SEQ ID NO: 3035 - RNA, 23 nt, Homo sapiens
aucccuugcaggggcuguugggu

SEQ ID NO: 3036 - RNA, 21 nt, Homo sapiens
cacaagguauugguauuaccu

SEQ ID NO: 3037 - RNA, 22 nt, Homo sapiens
uaguaccaguaccuuguguuca

SEQ ID NO: 3038 - RNA, 22 nt, Homo sapiens
gacuauagaacuuucccccuca

SEQ ID NO: 3039 - RNA, 21 nt, Homo sapiens
agggggaaaguucuauagucc

SEQ ID NO: 3040 - RNA, 19 nt, Homo sapiens
agcugucugaaaaugucuu

SEQ ID NO: 3041 - RNA, 22 nt, Homo sapiens
gugagucucuaagaaaagagga

SEQ ID NO: 3042 - RNA, 21 nt, Homo sapiens
ucuaguaagaguggcagucga

SEQ ID NO: 3043 - RNA, 22 nt, Homo sapiens
augcugacauauuuacuagagg

SEQ ID NO: 3044 - RNA, 22 nt, Homo sapiens
guucucccaacguaagcccagc

SEQ ID NO: 3045 - RNA, 21 nt, Homo sapiens
uggguuuacguugggagaacu

SEQ ID NO: 3046 - RNA, 22 nt, Homo sapiens
aguauucuguaccagggaaggu

SEQ ID NO: 3047 - RNA, 21 nt, Homo sapiens
agaccuggcccagaccucagc

SEQ ID NO: 3048 - RNA, 19 nt, Homo sapiens
gugucugcuuccuguggga

SEQ ID NO: 3049 - RNA, 23 nt, Homo sapiens
cuaauaguaucuaccacaauaaa

SEQ ID NO: 3050 - RNA, 22 nt, Homo sapiens
aaccagcaccccaacuuuggac

SEQ ID NO: 3051 - RNA, 23 nt, Homo sapiens
acuugggcacugaaacaaugucc

SEQ ID NO: 3052 - RNA, 23 nt, Homo sapiens
ugugcuugcucgucccgcccgca

SEQ ID NO: 3053 - RNA, 24 nt, Homo sapiens
acugggggcuuucgggcucugcgu

SEQ ID NO: 3054 - RNA, 25 nt, Homo sapiens
agggaucgcgggcggguggcggccu

SEQ ID NO: 3055 - RNA, 23 nt, Homo sapiens
aucgcugcgguugcgagcgcugu

SEQ ID NO: 3056 - RNA, 21 nt, Homo sapiens
augauccaggaaccugccucu

SEQ ID NO: 3057 - RNA, 24 nt, Homo sapiens
aaagacauaggauagagucaccuc

SEQ ID NO: 3058 - RNA, 22 nt, Homo sapiens
agacacauuuggagagggaacc

SEQ ID NO: 3059 - RNA, 22 nt, Homo sapiens
gucccucuccaaaugugucuug

SEQ ID NO: 3060 - RNA, 22 nt, Homo sapiens
agacacauuuggagagggaccc

SEQ ID NO: 3061 - RNA, 22 nt, Homo sapiens
gguucccucuccaaaugugucu

SEQ ID NO: 3062 - RNA, 22 nt, Homo sapiens
acuuguaugcuagcucagguag

SEQ ID NO: 3063 - RNA, 19 nt, Homo sapiens
aguguggcuuucuuagagc

SEQ ID NO: 3064 - RNA, 19 nt, Homo sapiens
ucuaggcugguacugcuga

SEQ ID NO: 3065 - RNA, 19 nt, Homo sapiens
aagcagcugccucugaggc

SEQ ID NO: 3066 - RNA, 21 nt, Homo sapiens
guggcugcacucacuuccuuc

SEQ ID NO: 3067 - RNA, 19 nt, Homo sapiens
aagugugcagggcacuggu

SEQ ID NO: 3068 - RNA, 22 nt, Homo sapiens
aaaccuguguuguucaagaguc

SEQ ID NO: 3069 - RNA, 22 nt, Homo sapiens
agcaguguuuguuuugcccaca

SEQ ID NO: 3070 - RNA, 22 nt, Homo sapiens
ucgggcgcaagagcacugcagu

SEQ ID NO: 3071 - RNA, 21 nt, Homo sapiens
aggaggcagcgcucucaggac

SEQ ID NO: 3072 - RNA, 21 nt, Homo sapiens
acacuuguugggaugaccugc

SEQ ID NO: 3073 - RNA, 24 nt, Homo sapiens
aggagcuauccacuccaggugucc

SEQ ID NO: 3074 - RNA, 23 nt, Homo sapiens
ccagagcagccugcgguaacagu

SEQ ID NO: 3075 - RNA, 22 nt, Homo sapiens
aguugccagggcugccuuuggu

SEQ ID NO: 3076 - RNA, 21 nt, Homo sapiens
uagaccaucuuucuagaguau

SEQ ID NO: 3077 - RNA, 22 nt, Homo sapiens
agcucuagaaagauuguugacc

SEQ ID NO: 3078 - RNA, 21 nt, Homo sapiens
gggacuaggaugcagaccucc

SEQ ID NO: 3079 - RNA, 23 nt, Homo sapiens
aggucugcauucaaauccccaga

SEQ ID NO: 3080 - RNA, 20 nt, Homo sapiens
cauuacagcacagccauucu

SEQ ID NO: 3081 - RNA, 21 nt, Homo sapiens
ucuggcugugcuguaaugcag

SEQ ID NO: 3082 - RNA, 21 nt, Homo sapiens
ugacuucuaccucuuccaaag

SEQ ID NO: 3083 - RNA, 22 nt, Homo sapiens
uuggaauaggggauaucucagc

SEQ ID NO: 3084 - RNA, 22 nt, Homo sapiens
ucguaucagagauuccagacac

SEQ ID NO: 3085 - RNA, 23 nt, Homo sapiens
acugggaugucacugaauauggu

SEQ ID NO: 3086 - RNA, 22 nt, Homo sapiens
caaaguccuuccuauuuuuccc

SEQ ID NO: 3087 - RNA, 21 nt, Homo sapiens
gaagaauaggagggacuuugu

SEQ ID NO: 3088 - RNA, 22 nt, Homo sapiens
ugggccaugcauuucuagaacu

SEQ ID NO: 3089 - RNA, 21 nt, Homo sapiens
ucuagaaaugcaugacccacc

SEQ ID NO: 3090 - RNA, 22 nt, Homo sapiens
uuccacugccacuaccuaauuu

SEQ ID NO: 3091 - RNA, 21 nt, Homo sapiens
auuagguaguggcaguggaac

SEQ ID NO: 3092 - RNA, 22 nt, Homo sapiens
uuuaggauaagcuugacuuuug

SEQ ID NO: 3093 - RNA, 21 nt, Homo sapiens
caccgacucugucuccugcag

SEQ ID NO: 3094 - RNA, 22 nt, Homo sapiens
cagcaggggagagagaggaguc

SEQ ID NO: 3095 - RNA, 22 nt, Homo sapiens
ccucaccaucccuucugccugc

SEQ ID NO: 3096 - RNA, 23 nt, Homo sapiens
caggcagaaguggggcugacagg

SEQ ID NO: 3097 - RNA, 23 nt, Homo sapiens
ccucaccaccccuucugccugca

SEQ ID NO: 3098 - RNA, 24 nt, Homo sapiens
cugcaggcagaaguggggcugaca

SEQ ID NO: 3099 - RNA, 22 nt, Homo sapiens
uuccagcccuucuaaugguagg

SEQ ID NO: 3100 - RNA, 22 nt, Homo sapiens
uaccauuagaagagcuggaaga

SEQ ID NO: 3101 - RNA, 21 nt, Homo sapiens
ucaagugucaucugucccuag

SEQ ID NO: 3102 - RNA, 23 nt, Homo sapiens
uuugggauugacgccacaugucu

SEQ ID NO: 3103 - RNA, 21 nt, Homo sapiens
cugccuguucuuccacuccag

SEQ ID NO: 3104 - RNA, 23 nt, Homo sapiens
uauggaguggacuuucagcuggc

SEQ ID NO: 3105 - RNA, 20 nt, Homo sapiens
ucucuucaucuaccccccag

SEQ ID NO: 3106 - RNA, 21 nt, Homo sapiens
uuggaggguguggaagacauc

SEQ ID NO: 3107 - RNA, 21 nt, Homo sapiens
aauggcgccacuaggguugug

SEQ ID NO: 3108 - RNA, 25 nt, Homo sapiens
caacccuaggagagggugccauuca

SEQ ID NO: 3109 - RNA, 21 nt, Homo sapiens
guguugaaacaaucucuacug

SEQ ID NO: 3110 - RNA, 22 nt, Homo sapiens
uaugucugcugaccaucaccuu

SEQ ID NO: 3111 - RNA, 22 nt, Homo sapiens
uggugggccgcagaacaugugc

SEQ ID NO: 3112 - RNA, 22 nt, Homo sapiens
auaauacaugguuaaccucuuu

SEQ ID NO: 3113 - RNA, 21 nt, Homo sapiens
aauauuauacagucaaccucu

SEQ ID NO: 3114 - RNA, 23 nt, Homo sapiens
ggcagguucucacccucucuagg

SEQ ID NO: 3115 - RNA, 25 nt, Homo sapiens
ggcggagggaaguagguccguuggu

SEQ ID NO: 3116 - RNA, 22 nt, Homo sapiens
cuugguucagggagggucccca

SEQ ID NO: 3117 - RNA, 22 nt, Homo sapiens
aggaccuucccugaaccaagga

SEQ ID NO: 3118 - RNA, 21 nt, Homo sapiens
accuccugugugcauggauua

SEQ ID NO: 3119 - RNA, 22 nt, Homo sapiens
uacccauugcauaucggaguug

SEQ ID NO: 3120 - RNA, 24 nt, Homo sapiens
ugccugggucucuggccugcgcgu

SEQ ID NO: 3121 - RNA, 21 nt, Homo sapiens
ucccacguuguggcccagcag

SEQ ID NO: 3122 - RNA, 22 nt, Homo sapiens
aggcggggcgccgcgggaccgc

SEQ ID NO: 3123 - RNA, 22 nt, Homo sapiens
gguggcccggccgugccugagg

SEQ ID NO: 3124 - RNA, 23 nt, Homo sapiens
uauucauuuauccccagccuaca

SEQ ID NO: 3125 - RNA, 24 nt, Homo sapiens
acuggcuagggaaaaugauuggau

SEQ ID NO: 3126 - RNA, 22 nt, Homo sapiens
uucauuugccucccagccuaca

SEQ ID NO: 3127 - RNA, 24 nt, Homo sapiens
ugggcuaagggagaugauugggua

SEQ ID NO: 3128 - RNA, 20 nt, Homo sapiens
accaggaggcugaggccccu

SEQ ID NO: 3129 - RNA, 23 nt, Homo sapiens
ugucacucggcucggcccacuac

SEQ ID NO: 3130 - RNA, 20 nt, Homo sapiens
gucccugaguguauguggug

SEQ ID NO: 3131 - RNA, 21 nt, Homo sapiens
uccgguucucagggcuccacc

SEQ ID NO: 3132 - RNA, 21 nt, Homo sapiens
ccaaaccagucgugccugugg

SEQ ID NO: 3133 - RNA, 22 nt, Homo sapiens
cucaaaccggcugugccugugg

SEQ ID NO: 3134 - RNA, 21 nt, Homo sapiens
acaggcacgacugguuuggca

SEQ ID NO: 3135 - RNA, 23 nt, Homo sapiens
aggaagcccuggaggggcuggag

SEQ ID NO: 3136 - RNA, 22 nt, Homo sapiens
uccgaacucuccauuccucugc

SEQ ID NO: 3137 - RNA, 20 nt, Homo sapiens
ugggaauggggguaagggcc

SEQ ID NO: 3138 - RNA, 22 nt, Homo sapiens
aggcgauguggggauguagaga

SEQ ID NO: 3139 - RNA, 21 nt, Homo sapiens
uaguggucagagggcuuauga

SEQ ID NO: 3140 - RNA, 22 nt, Homo sapiens
ucugacaucagugauucuccug

SEQ ID NO: 3141 - RNA, 22 nt, Homo sapiens
cgcgccugcaggaacugguaga

SEQ ID NO: 3142 - RNA, 23 nt, Homo sapiens
ugggcaggggcuuauuguaggag

SEQ ID NO: 3143 - RNA, 22 nt, Homo sapiens
ugcaggggucgggugggccagg

SEQ ID NO: 3144 - RNA, 20 nt, Homo sapiens
aggcgcacccgaccacaugc

SEQ ID NO: 3145 - RNA, 22 nt, Homo sapiens
auaguccgaguaacgucggggc

SEQ ID NO: 3146 - RNA, 23 nt, Homo sapiens
cugggcccgcggcgggcgugggg

SEQ ID NO: 3147 - RNA, 20 nt, Homo sapiens
cuguaugcccucaccgcuca

SEQ ID NO: 3148 - RNA, 23 nt, Homo sapiens
uggugcggagagggcccacagug

SEQ ID NO: 3149 - RNA, 21 nt, Homo sapiens
cuguccuaagguuguugaguu

SEQ ID NO: 3150 - RNA, 21 nt, Homo sapiens
ucuucaaccucaggacuugca

SEQ ID NO: 3151 - RNA, 22 nt, Homo sapiens
caacuagacugugagcuucuag

SEQ ID NO: 3152 - RNA, 23 nt, Homo sapiens
aaggagcuuacaaucuagcuggg

SEQ ID NO: 3153 - RNA, 22 nt, Homo sapiens
gggacccagggagagacguaag

SEQ ID NO: 3154 - RNA, 22 nt, Homo sapiens
caacaaaucacagucugccaua

SEQ ID NO: 3155 - RNA, 21 nt, Homo sapiens
cuuccgccccgccgggcgucg

SEQ ID NO: 3156 - RNA, 22 nt, Homo sapiens
caacaaaucccagucuaccuaa

SEQ ID NO: 3157 - RNA, 22 nt, Homo sapiens
cuguugccacuaaccucaaccu

SEQ ID NO: 3158 - RNA, 22 nt, Homo sapiens
ugcggggcuagggcuaacagca

SEQ ID NO: 3159 - RNA, 22 nt, Homo sapiens
uuugugaccugguccacuaacc

SEQ ID NO: 3160 - RNA, 22 nt, Homo sapiens
gaugguugaccagagagcacac

SEQ ID NO: 3161 - RNA, 22 nt, Homo sapiens
gcagagugcaaacaauuuugac

SEQ ID NO: 3162 - RNA, 23 nt, Homo sapiens
uggaagacuagugauuuuguugu

SEQ ID NO: 3163 - RNA, 20 nt, Homo sapiens
cggcucugggucugugggga

SEQ ID NO: 3164 - RNA, 22 nt, Homo sapiens
gcagcagggugaaacugacaca

SEQ ID NO: 3165 - RNA, 22 nt, Homo sapiens
ggggcuggggccggggccgagc

SEQ ID NO: 3166 - RNA, 22 nt, Homo sapiens
gcaggugcucacuuguccuccu

SEQ ID NO: 3167 - RNA, 21 nt, Homo sapiens
uggaggagaaggaaggugaug

SEQ ID NO: 3168 - RNA, 22 nt, Homo sapiens
acuccagccccacagccucagc

SEQ ID NO: 3169 - RNA, 22 nt, Homo sapiens
aggaggaauuggugcuggucuu

SEQ ID NO: 3170 - RNA, 23 nt, Homo sapiens
ucugcucauaccccaugguuucu

SEQ ID NO: 3171 - RNA, 23 nt, Homo sapiens
ugcaccaugguugucugagcaug

SEQ ID NO: 3172 - RNA, 23 nt, Homo sapiens
cugggaucuccggggucuugguu

SEQ ID NO: 3173 - RNA, 22 nt, Homo sapiens
ugagaccucuggguucugagcu

SEQ ID NO: 3174 - RNA, 23 nt, Homo sapiens
uccaguaccacgugucagggcca

SEQ ID NO: 3175 - RNA, 23 nt, Homo sapiens
caguaacaaagauucauccuugu

SEQ ID NO: 3176 - RNA, 22 nt, Homo sapiens
ggagacugaugaguucccggga

SEQ ID NO: 3177 - RNA, 21 nt, Homo sapiens
gcaggaacuugugagucuccu

SEQ ID NO: 3178 - RNA, 22 nt, Homo sapiens
cugcccuggcccgagggaccga

SEQ ID NO: 3179 - RNA, 21 nt, Homo sapiens
ccuggaaacacugagguugug

SEQ ID NO: 3180 - RNA, 22 nt, Homo sapiens
uauaccucaguuuuaucaggug

SEQ ID NO: 3181 - RNA, 22 nt, Homo sapiens
uggugguuuacaaaguaauuca

SEQ ID NO: 3182 - RNA, 22 nt, Homo sapiens
uggauuucuuugugaaucacca

SEQ ID NO: 3183 - RNA, 21 nt, Homo sapiens
uccucuucucccuccucccag

SEQ ID NO: 3184 - RNA, 20 nt, Homo sapiens
guagaggagauggcgcaggg

SEQ ID NO: 3185 - RNA, 22 nt, Homo sapiens
aggcagcgggguguaguggaua

SEQ ID NO: 3186 - RNA, 22 nt, Homo sapiens
uccauuacacuacccugccucu

SEQ ID NO: 3187 - RNA, 22 nt, Homo sapiens
gugaacgggcgccaucccgagg

SEQ ID NO: 3188 - RNA, 22 nt, Homo sapiens
gacugacaccucuuugggugaa

SEQ ID NO: 3189 - RNA, 21 nt, Homo sapiens
uacucaaaaagcugucaguca

SEQ ID NO: 3190 - RNA, 21 nt, Homo sapiens
uuaauaucggacaaccauugu

SEQ ID NO: 3191 - RNA, 21 nt, Homo sapiens
uacuuggaaaggcaucaguug

SEQ ID NO: 3192 - RNA, 22 nt, Homo sapiens
ugcaacgaaccugagccacuga

SEQ ID NO: 3193 - RNA, 22 nt, Homo sapiens
ugcaacuuaccugagucauuga

SEQ ID NO: 3194 - RNA, 21 nt, Homo sapiens
cacuguguccuuucugcguag

SEQ ID NO: 3195 - RNA, 22 nt, Homo sapiens
cacuggcuccuuucuggguaga

SEQ ID NO: 3196 - RNA, 22 nt, Homo sapiens
cacuguuuccuuucugagugga

SEQ ID NO: 3197 - RNA, 21 nt, Homo sapiens
uauucagaaaggugccaguca

SEQ ID NO: 3198 - RNA, 20 nt, Homo sapiens
ggggagcuguggaagcagua

SEQ ID NO: 3199 - RNA, 25 nt, Homo sapiens
cuagugagggacagaaccaggauuc

SEQ ID NO: 3200 - RNA, 23 nt, Homo sapiens
gcagcagagaauaggacuacguc

SEQ ID NO: 3201 - RNA, 20 nt, Homo sapiens
agagucuugugaugucuugc

SEQ ID NO: 3202 - RNA, 23 nt, Homo sapiens
agguugggaucgguugcaaugcu

SEQ ID NO: 3203 - RNA, 22 nt, Homo sapiens
ggguggggauuuguugcauuac

SEQ ID NO: 3204 - RNA, 22 nt, Homo sapiens
uauugcacuugucccggccugu

SEQ ID NO: 3205 - RNA, 22 nt, Homo sapiens
uauugcacucgucccggccucc

SEQ ID NO: 3206 - RNA, 22 nt, Homo sapiens
agggacgggacgcggugcagug

SEQ ID NO: 3207 - RNA, 22 nt, Homo sapiens
ugugcgcagggagaccucuccc

SEQ ID NO: 3208 - RNA, 22 nt, Homo sapiens
acugcugagcuagcacuucccg

SEQ ID NO: 3209 - RNA, 22 nt, Homo sapiens
ugucuacuacuggagacacugg

SEQ ID NO: 3210 - RNA, 23 nt, Homo sapiens
ccaguuaccgcuuccgcuaccgc

SEQ ID NO: 3211 - RNA, 23 nt, Homo sapiens
caaagugcuguucgugcagguag

SEQ ID NO: 3212 - RNA, 22 nt, Homo sapiens
acaguagagggaggaaucgcag

SEQ ID NO: 3213 - RNA, 22 nt, Homo sapiens
auccgcgcucugacucucugcc

SEQ ID NO: 3214 - RNA, 20 nt, Homo sapiens
gugagucaggguggggcugg

SEQ ID NO: 3215 - RNA, 22 nt, Homo sapiens
ugcccuuaaaggugaacccagu

SEQ ID NO: 3216 - RNA, 21 nt, Homo sapiens
cccugggccucugcuccccag

SEQ ID NO: 3217 - RNA, 24 nt, Homo sapiens
uggggagcugaggcucugggggug

SEQ ID NO: 3218 - RNA, 22 nt, Homo sapiens
auaaagcuagauaaccgaaagu

SEQ ID NO: 3219 - RNA, 21 nt, Homo sapiens
aaggcagggcccccgcucccc

SEQ ID NO: 3220 - RNA, 23 nt, Homo sapiens
cacccggcugugugcacaugugc

SEQ ID NO: 3221 - RNA, 22 nt, Homo sapiens
ucuucucuguuuuggccaugug

SEQ ID NO: 3222 - RNA, 21 nt, Homo sapiens
cugacuguugccguccuccag

SEQ ID NO: 3223 - RNA, 22 nt, Homo sapiens
aaauuauuguacaucggaugag

SEQ ID NO: 3224 - RNA, 22 nt, Homo sapiens
uucaacggguauuuauugagca

SEQ ID NO: 3225 - RNA, 23 nt, Homo sapiens
ucuuugguuaucuagcuguauga

SEQ ID NO: 3226 - RNA, 22 nt, Homo sapiens
aaucaugugcagugccaauaug

SEQ ID NO: 3227 - RNA, 23 nt, Homo sapiens
uuuggcacuagcacauuuuugcu

SEQ ID NO: 3228 - RNA, 22 nt, Homo sapiens
cuauacaacuuacuacuuuccc

SEQ ID NO: 3229 - RNA, 22 nt, Homo sapiens
ugagguaguaaguuguauuguu

SEQ ID NO: 3230 - RNA, 22 nt, Homo sapiens
caagcucgcuucuaugggucug

SEQ ID NO: 3231 - RNA, 22 nt, Homo sapiens
aacccguagauccgaucuugug

SEQ ID NO: 3232 - RNA, 22 nt, Homo sapiens
caagcucgugucuguggguccg

SEQ ID NO: 3233 - RNA, 22 nt, Homo sapiens
cacccguagaaccgaccuugcg

SEQ ID NO: 3234 - RNA, 22 nt, Homo sapiens
uuaaaccucuacuaaguuccca

SEQ ID NO: 3235 - RNA, 18 nt, Homo sapiens
aaaacaacaccccccacc

SEQ ID NO: 3236 - RNA, 22 nt, Homo sapiens
uacuuguaacggagagcacuag

SEQ ID NO: 3237 - RNA, 22 nt, Homo sapiens
uuagccucaugaccagccacaa

SEQ ID NO: 3238 - RNA, 21 nt, Homo sapiens
ugugucugaucaugagacuaa

SEQ ID NO: 3239 - RNA, 22 nt, Homo sapiens
auaaugaaugcuuggucccuug

SEQ ID NO: 3240 - RNA, 22 nt, Homo sapiens
gccugucccuaaauccuuccug

SEQ ID NO: 3241 - RNA, 22 nt, Homo sapiens
gaaucacaaauguccuuaauag

SEQ ID NO: 3242 - RNA, 22 nt, Homo sapiens
aucaaucacaaauguccuuaau

SEQ ID NO: 3243 - RNA, 17 nt, Homo sapiens
cuccucagcucagccuc

SEQ ID NO: 3244 - RNA, 22 nt, Homo sapiens
cugcuccgagcacggccgcgcg

SEQ ID NO: 3245 - RNA, 22 nt, Homo sapiens
augggacauccuacauaugcaa

SEQ ID NO: 3246 - RNA, 21 nt, Homo sapiens
uaaaguaacuuccacuuggcu

SEQ ID NO: 3247 - RNA, 17 nt, Homo sapiens
aaccaccagcccacucc

SEQ ID NO: 3248 - RNA, 22 nt, Homo sapiens
gagccccacugagaaauagaaa

SEQ ID NO: 3249 - RNA, 22 nt, Homo sapiens
cauuuccauagcccacuggguu

SEQ ID NO: 3250 - RNA, 17 nt, Homo sapiens
caacaacagaccacccc

SEQ ID NO: 3251 - RNA, 20 nt, Homo sapiens
uggggcuucucccgccuuuu

SEQ ID NO: 3252 - RNA, 20 nt, Homo sapiens
uuaggguaccgcggccguua

SEQ ID NO: 3253 - RNA, 17 nt, Homo sapiens
ugccagccucgcccagc

SEQ ID NO: 3254 - RNA, 19 nt, Homo sapiens
cugcccuucagccagcucu

SEQ ID NO: 3255 - RNA, 18 nt, Homo sapiens
cgccggagcccgcccccu

SEQ ID NO: 3256 - RNA, 21 nt, Homo sapiens
cguccugcaucacuagcccca

SEQ ID NO: 3257 - RNA, 22 nt, Homo sapiens
uaugcccaaaucucuuaccaga

SEQ ID NO: 3258 - RNA, 22 nt, Homo sapiens
uuuggucacaccaguccacauu

SEQ ID NO: 3259 - RNA, 17 nt, Homo sapiens
ggcgcgcgcccagcccc

SEQ ID NO: 3260 - RNA, 21 nt, Homo sapiens
acagagauggaaaggccuucu

SEQ ID NO: 3261 - RNA, 22 nt, Homo sapiens
ccucuggucagccacagucugg

SEQ ID NO: 3262 - RNA, 21 nt, Homo sapiens
agcaaaaagccuguuuacauu

SEQ ID NO: 3263 - RNA, 22 nt, Homo sapiens
cccucucagcuucaguuuccuc

SEQ ID NO: 3264 - RNA, 17 nt, Homo sapiens
gcccagccgucccggag

SEQ ID NO: 3265 - RNA, 22 nt, Homo sapiens
cagcacuugcccugccagccca

SEQ ID NO: 3266 - RNA, 17 nt, Homo sapiens
ucccuccucucagucuu

SEQ ID NO: 3267 - RNA, 22 nt, Homo sapiens
accagcuaacaauacacugcca

SEQ ID NO: 3268 - RNA, 22 nt, Homo sapiens
aguggcaggguaguuguggcug

SEQ ID NO: 3269 - RNA, 22 nt, Homo sapiens
gccagcuaacaauacacugccu

SEQ ID NO: 3270 - RNA, 23 nt, Homo sapiens
acagagaggagugcaacuagcaa

SEQ ID NO: 3271 - RNA, 25 nt, Homo sapiens
acagccgcuagcaauacacugccua

SEQ ID NO: 3272 - RNA, 17 nt, Homo sapiens
aagaaacuacuaccuca

SEQ ID NO: 3273 - RNA, 21 nt, Homo sapiens
ugauucauccgaggucacaua

SEQ ID NO: 3274 - RNA, 22 nt, Homo sapiens
cuucagcaccaucaucaucagc

SEQ ID NO: 3275 - RNA, 22 nt, Homo sapiens
uaaauucuauuuccugcuuaaa

SEQ ID NO: 3276 - RNA, 22 nt, Homo sapiens
cauguucaucucuauugucaca

SEQ ID NO: 3277 - RNA, 18 nt, Homo sapiens
uccgucccagcccagccu

SEQ ID NO: 3278 - RNA, 20 nt, Homo sapiens
uugccucagaccacccauuu

SEQ ID NO: 3279 - RNA, 20 nt, Homo sapiens
cccagcccagcccaacccag

SEQ ID NO: 3280 - RNA, 17 nt, Homo sapiens
cgcgcgcccagccccgc

SEQ ID NO: 3281 - RNA, 22 nt, Homo sapiens
aaaaccuucuauauccuuuagu

SEQ ID NO: 3282 - RNA, 22 nt, Homo sapiens
augaaugcaaaauguccccaau

SEQ ID NO: 3283 - RNA, 22 nt, Homo sapiens
auauuaggaacacaucgcaaaa

SEQ ID NO: 3284 - RNA, 22 nt, Homo sapiens
uauggaugcaaaaugaucccaa

SEQ ID NO: 3285 - RNA, 22 nt, Homo sapiens
uauucaggaacauauugcaaaa

SEQ ID NO: 3286 - RNA, 22 nt, Homo sapiens
aaccauacauccuacucccuca

SEQ ID NO: 3287 - RNA, 22 nt, Homo sapiens
agggcaaaugcaacaguucuuc

SEQ ID NO: 3288 - RNA, 22 nt, Homo sapiens
ugggcgauacagugaggcccug

SEQ ID NO: 3289 - RNA, 22 nt, Homo sapiens
augggccuccagccgucagucu

SEQ ID NO: 3290 - RNA, 18 nt, Homo sapiens
uuccccaauccugccugu

SEQ ID NO: 3291 - RNA, 22 nt, Homo sapiens
gggcugccgggaguccaguccu

SEQ ID NO: 3292 - RNA, 17 nt, Homo sapiens
gccccgacccuucuccc

SEQ ID NO: 3293 - RNA, 25 nt, Homo sapiens
cucagcugugaguuucaucauauuu

SEQ ID NO: 3294 - RNA, 26 nt, Homo sapiens
ucucagcacaguuaucaucccugagc

SEQ ID NO: 3295 - RNA, 18 nt, Homo sapiens
cagcccugcgcacugcug

SEQ ID NO: 3296 - RNA, 22 nt, Homo sapiens
aacucaguaaugguaacgguuu

SEQ ID NO: 3297 - RNA, 22 nt, Homo sapiens
aaugguaaugguucucuugcua

SEQ ID NO: 3298 - RNA, 22 nt, Homo sapiens
uuccugcguguuuucuguccaa

SEQ ID NO: 3299 - RNA, 20 nt, Homo sapiens
uuggacagaaaacacgcagg

SEQ ID NO: 3300 - RNA, 22 nt, Homo sapiens
accugcguguuuucuguccaaa

SEQ ID NO: 3301 - RNA, 20 nt, Homo sapiens
uuggacagaaaacacgcagg

SEQ ID NO: 3302 - RNA, 22 nt, Homo sapiens
cugagcacaggacuuccuuagc

SEQ ID NO: 3303 - RNA, 21 nt, Homo sapiens
accggccuacaggcagaguca

SEQ ID NO: 3304 - RNA, 21 nt, Homo sapiens
acagccgaggcccucucgguc

SEQ ID NO: 3305 - RNA, 22 nt, Homo sapiens
cacuuacuucuuugcagaugag

SEQ ID NO: 3306 - RNA, 22 nt, Homo sapiens
auagcagcauaagccugucuca

SEQ ID NO: 3307 - RNA, 22 nt, Homo sapiens
ugagacagguucaugcugcuau

SEQ ID NO: 3308 - RNA, 20 nt, Homo sapiens
uagcagcaugaaccugucuc

SEQ ID NO: 3309 - RNA, 21 nt, Homo sapiens
gagacaggcuuaugcugcuau

SEQ ID NO: 3310 - RNA, 21 nt, Homo sapiens
aaccagcaugcacaucccccc

SEQ ID NO: 3311 - RNA, 22 nt, Homo sapiens
ucaguuuccucugcaaacaguu

SEQ ID NO: 3312 - RNA, 22 nt, Homo sapiens
agcggccagcccugcugucagc

SEQ ID NO: 3313 - RNA, 22 nt, Homo sapiens
acagucaucucuuugcagacca

SEQ ID NO: 3314 - RNA, 22 nt, Homo sapiens
guccagaucauacauauaauga

SEQ ID NO: 3315 - RNA, 21 nt, Homo sapiens
acgggccaucagcaguccaau

SEQ ID NO: 3316 - RNA, 22 nt, Homo sapiens
uucauuggacugcugauggccu

SEQ ID NO: 3317 - RNA, 18 nt, Homo sapiens
cgcucccguccugcuggg

SEQ ID NO: 3318 - RNA, 17 nt, Homo sapiens
ucagaagccuucuccau

SEQ ID NO: 3319 - RNA, 17 nt, Homo sapiens
cgccgggcuccccgggg

SEQ ID NO: 3320 - RNA, 22 nt, Homo sapiens
agcguccggcaaccuccuucca

SEQ ID NO: 3321 - RNA, 17 nt, Homo sapiens
agaccccuccuccaucc

SEQ ID NO: 3322 - RNA, 17 nt, Homo sapiens
gucccagccagguccac

SEQ ID NO: 3323 - RNA, 21 nt, Homo sapiens
augugguagauauaugcacga

SEQ ID NO: 3324 - RNA, 21 nt, Homo sapiens
aucgugcauauaucuaccaca

SEQ ID NO: 3325 - RNA, 22 nt, Homo sapiens
cagcuaagcucagcucggcuca

SEQ ID NO: 3326 - RNA, 22 nt, Homo sapiens
ucagcccagcucauccaagcuc

SEQ ID NO: 3327 - RNA, 22 nt, Homo sapiens
gcccagcucagcccaguucagc

SEQ ID NO: 3328 - RNA, 21 nt, Homo sapiens
uaaaccuacaggcaggacuaa

SEQ ID NO: 3329 - RNA, 23 nt, Homo sapiens
acccuauaagcaauauugcacua

SEQ ID NO: 3330 - RNA, 22 nt, Homo sapiens
gcagagacaauauugauagggu

SEQ ID NO: 3331 - RNA, 21 nt, Homo sapiens
guguauaugcccauggacugc

SEQ ID NO: 3332 - RNA, 22 nt, Homo sapiens
cgauguaguccaaaggcacaua

SEQ ID NO: 3333 - RNA, 22 nt, Homo sapiens
cuagagcagcgagagggcggca

SEQ ID NO: 3334 - RNA, 23 nt, Homo sapiens
uccgccacacccacgcugcccuc

SEQ ID NO: 3335 - RNA, 22 nt, Homo sapiens
ugcauaugccuggcuagcuccu

SEQ ID NO: 3336 - RNA, 20 nt, Homo sapiens
gaggagcuagccaggcauau

SEQ ID NO: 3337 - RNA, 19 nt, Homo sapiens
ccccgggccggucgcgccg

SEQ ID NO: 3338 - RNA, 21 nt, Homo sapiens
uugcggguucugacuucaaga

SEQ ID NO: 3339 - RNA, 22 nt, Homo sapiens
cuaaaggcuuugaacacgaguu

SEQ ID NO: 3340 - RNA, 22 nt, Homo sapiens
ucacuugaaucugcaguuagua

SEQ ID NO: 3341 - RNA, 23 nt, Homo sapiens
cggccggcugagcgguguccagg

SEQ ID NO: 3342 - RNA, 21 nt, Homo sapiens
acuuguccaccgcagccgagu

SEQ ID NO: 3343 - RNA, 20 nt, Homo sapiens
gcaaagcaaggugagaguga

SEQ ID NO: 3344 - RNA, 22 nt, Homo sapiens
ucaaucucagccuacuuagcaa

SEQ ID NO: 3345 - RNA, 22 nt, Homo sapiens
gugggccaggaaacagggggug

SEQ ID NO: 3346 - RNA, 23 nt, Homo sapiens
cccaccagcugcucccuggccca

SEQ ID NO: 3347 - RNA, 24 nt, Homo sapiens
ugaggcaaaaguauggcaugggca

SEQ ID NO: 3348 - RNA, 22 nt, Homo sapiens
agccaccaggggacgaugccau

SEQ ID NO: 3349 - RNA, 22 nt, Homo sapiens
uuagcauuuauggucauguguc

SEQ ID NO: 3350 - RNA, 23 nt, Homo sapiens
cuucugucucuuuucucucucca

SEQ ID NO: 3351 - RNA, 22 nt, Homo sapiens
aaccaggcaagaacuacugucu

SEQ ID NO: 3352 - RNA, 19 nt, Homo sapiens
acaauauuucuugccuggu

SEQ ID NO: 3353 - RNA, 21 nt, Homo sapiens
cugggaagggagagggacaau

SEQ ID NO: 3354 - RNA, 22 nt, Homo sapiens
ucccucagcuccucuucccagu

SEQ ID NO: 3355 - RNA, 23 nt, Homo sapiens
uuccucagcacagcaccaucuuc

SEQ ID NO: 3356 - RNA, 20 nt, Homo sapiens
cucccauuugcagucccaca

SEQ ID NO: 3357 - RNA, 21 nt, Homo sapiens
uggggagaggcaggccucaga

SEQ ID NO: 3358 - RNA, 24 nt, Homo sapiens
cucugagagcccaccccucgccca

SEQ ID NO: 3359 - RNA, 21 nt, Homo sapiens
augucaggccucauucuaccu

SEQ ID NO: 3360 - RNA, 19 nt, Homo sapiens
aagguagaaagaggccuga

SEQ ID NO: 3361 - RNA, 20 nt, Homo sapiens
gcccgaccucacccaccccg

SEQ ID NO: 3362 - RNA, 22 nt, Homo sapiens
ugaggggauggguuaacagaac

SEQ ID NO: 3363 - RNA, 22 nt, Homo sapiens
uaguucuauuaaccaguccccu

SEQ ID NO: 3364 - RNA, 23 nt, Homo sapiens
ucuccaagcaacccuuaacucca

SEQ ID NO: 3365 - RNA, 22 nt, Homo sapiens
gguguuaagccuugcucagaga

SEQ ID NO: 3366 - RNA, 22 nt, Homo sapiens
ccagaugccuccagaucccaca

SEQ ID NO: 3367 - RNA, 21 nt, Homo sapiens
ccccggggaccugacgagggu

SEQ ID NO: 3368 - RNA, 22 nt, Homo sapiens
cgacccucugccauccccggug

SEQ ID NO: 3369 - RNA, 23 nt, Homo sapiens
acaggccuccugcccucagccca

SEQ ID NO: 3370 - RNA, 23 nt, Homo sapiens
augccucagaccacuuccacauu

SEQ ID NO: 3371 - RNA, 23 nt, Homo sapiens
auuccuccaggauccacacucac

SEQ ID NO: 3372 - RNA, 22 nt, Homo sapiens
cguugccaugucuaagaagaaa

SEQ ID NO: 3373 - RNA, 22 nt, Homo sapiens
guuuucuucuuagacauggcag

SEQ ID NO: 3374 - RNA, 22 nt, Homo sapiens
agcugccaugucuaagaagaaa

SEQ ID NO: 3375 - RNA, 19 nt, Homo sapiens
uucuucuuagacauggcaa

SEQ ID NO: 3376 - RNA, 23 nt, Homo sapiens
auguguguugcguguauguguau

SEQ ID NO: 3377 - RNA, 23 nt, Homo sapiens
cuccauuuuccaccagagcugca

SEQ ID NO: 3378 - RNA, 22 nt, Homo sapiens
uggacuagcucuguggauccug

SEQ ID NO: 3379 - RNA, 22 nt, Homo sapiens
gucaggauccacagagcuaguu

SEQ ID NO: 3380 - RNA, 22 nt, Homo sapiens
auuuagccaauugucuaucuuu

SEQ ID NO: 3381 - RNA, 22 nt, Homo sapiens
cuaaagauggacaauuggcuaa

SEQ ID NO: 3382 - RNA, 22 nt, Homo sapiens
auuuagccaauuguccaucuuu

SEQ ID NO: 3383 - RNA, 24 nt, Homo sapiens
acugcacguccauggagcucagcu

SEQ ID NO: 3384 - RNA, 22 nt, Homo sapiens
gacggggcucacagaccggaag

SEQ ID NO: 3385 - RNA, 22 nt, Homo sapiens
aacuugcggagugggcacccca

SEQ ID NO: 3386 - RNA, 26 nt, Homo sapiens
ggcgggggcuacgcgccgcggccgag

SEQ ID NO: 3387 - RNA, 23 nt, Homo sapiens
gcucgcgcucacgcgucccccag

SEQ ID NO: 3388 - RNA, 21 nt, Homo sapiens
aaauacaugucagauuguaug

SEQ ID NO: 3389 - RNA, 21 nt, Homo sapiens
ggcauacaaucugacauguau

SEQ ID NO: 3390 - RNA, 23 nt, Homo sapiens
gggaauuacaaucugacaugcaa

SEQ ID NO: 3391 - RNA, 21 nt, Homo sapiens
cuguggggacagaaggaggga

SEQ ID NO: 3392 - RNA, 22 nt, Homo sapiens
gguucuccuucugcuccccagu

SEQ ID NO: 3393 - RNA, 23 nt, Homo sapiens
cuggaaaaacaaaaaggauuuuc

SEQ ID NO: 3394 - RNA, 23 nt, Homo sapiens
gacaaauccuuuuuuuuuucccu

SEQ ID NO: 3395 - RNA, 22 nt, Homo sapiens
ccuccuccacuucccggacaca

SEQ ID NO: 3396 - RNA, 22 nt, Homo sapiens
aagcgaccaugauguaacuuca

SEQ ID NO: 3397 - RNA, 22 nt, Homo sapiens
ugaaguuacaucauggucgcuu

SEQ ID NO: 3398 - RNA, 21 nt, Homo sapiens
agaccaaagacuaugcacuaa

SEQ ID NO: 3399 - RNA, 22 nt, Homo sapiens
agauuagcgcacagucuucggu

SEQ ID NO: 3400 - RNA, 21 nt, Homo sapiens
ugccucuguccagcuguguaa

SEQ ID NO: 3401 - RNA, 22 nt, Homo sapiens
uccaguccggcuccugccugga

SEQ ID NO: 3402 - RNA, 21 nt, Homo sapiens
agccgcgcgucccgagcccag

SEQ ID NO: 3403 - RNA, 22 nt, Homo sapiens
ccugcuggucaaucacagcccc

SEQ ID NO: 3404 - RNA, 22 nt, Homo sapiens
aagagccaguggugaaacagug

SEQ ID NO: 3405 - RNA, 21 nt, Homo sapiens
ucacugucucaccacuggcuc

SEQ ID NO: 3406 - RNA, 22 nt, Homo sapiens
aguaguucuuuggucucacaga

SEQ ID NO: 3407 - RNA, 22 nt, Homo sapiens
uggcugaaagaccaaagaacaa

SEQ ID NO: 3408 - RNA, 22 nt, Homo sapiens
ucauaagucugaacaauaccuu

SEQ ID NO: 3409 - RNA, 22 nt, Homo sapiens
agcaaagaaucucuaucacaga

SEQ ID NO: 3410 - RNA, 21 nt, Homo sapiens
uaacaacucuuacaauucaga

SEQ ID NO: 3411 - RNA, 23 nt, Homo sapiens
acaucuaagacugcaagaguucu

SEQ ID NO: 3412 - RNA, 22 nt, Homo sapiens
agauacagccugcauucccguu

SEQ ID NO: 3413 - RNA, 23 nt, Homo sapiens
agaccaggcuccaggaacucaga

SEQ ID NO: 3414 - RNA, 23 nt, Homo sapiens
aucgggcgagcacuggaucucca

SEQ ID NO: 3415 - RNA, 22 nt, Homo sapiens
acgucuccaccgacuugcaaca

SEQ ID NO: 3416 - RNA, 22 nt, Homo sapiens
uauguugcaagucaguagagag

SEQ ID NO: 3417 - RNA, 22 nt, Homo sapiens
cuagccagggcaggaagggaga

SEQ ID NO: 3418 - RNA, 26 nt, Homo sapiens
aaccuugccccacuccaagcccuggg

SEQ ID NO: 3419 - RNA, 23 nt, Homo sapiens
aacaccagaaagcccagcagaua

SEQ ID NO: 3420 - RNA, 21 nt, Homo sapiens
gccugcccccuccaacagcca

SEQ ID NO: 3421 - RNA, 22 nt, Homo sapiens
uuugggugcgggaggagggcug

SEQ ID NO: 3422 - RNA, 22 nt, Homo sapiens
cccagguccucugcugccccua

SEQ ID NO: 3423 - RNA, 22 nt, Homo sapiens
ggcccccaccaugucuccucaa

SEQ ID NO: 3424 - RNA, 21 nt, Homo sapiens
cagaggccucagcugggcugc

SEQ ID NO: 3425 - RNA, 22 nt, Homo sapiens
uucagcccagccucgccugcuc

SEQ ID NO: 3426 - RNA, 23 nt, Homo sapiens
augcacucucaguccguggcugg

SEQ ID NO: 3427 - RNA, 23 nt, Homo sapiens
ccgcagcucauggccuggaggac

SEQ ID NO: 3428 - RNA, 22 nt, Homo sapiens
aucugauacccacacugccuga

SEQ ID NO: 3429 - RNA, 23 nt, Homo sapiens
aaauacugugaauuccacucuca

SEQ ID NO: 3430 - RNA, 23 nt, Homo sapiens
ugugacagugaaauucacaguau

SEQ ID NO: 3431 - RNA, 21 nt, Homo sapiens
agguguuauccuguccauuug

SEQ ID NO: 3432 - RNA, 22 nt, Homo sapiens
gcaaauggauaggauaacaccu

SEQ ID NO: 3433 - RNA, 22 nt, Homo sapiens
gaaggaggcagcggugagauca

SEQ ID NO: 3434 - RNA, 22 nt, Homo sapiens
ccugcucgcccacugccuccug

SEQ ID NO: 3435 - RNA, 22 nt, Homo sapiens
agaugacaguauccgucuugca

SEQ ID NO: 3436 - RNA, 24 nt, Homo sapiens
accaaggggcaggagucacugaca

SEQ ID NO: 3437 - RNA, 22 nt, Homo sapiens
cacgucagugacugcgcccccu

SEQ ID NO: 3438 - RNA, 23 nt, Homo sapiens
uggggucuuccucuacauuuuga

SEQ ID NO: 3439 - RNA, 22 nt, Homo sapiens
ggagaagauugcagaguaaauu

SEQ ID NO: 3440 - RNA, 22 nt, Homo sapiens
ggaacuuacucugcaaucuucu

SEQ ID NO: 3441 - RNA, 26 nt, Homo sapiens
cacuggggugaggagucaguccugug

SEQ ID NO: 3442 - RNA, 22 nt, Homo sapiens
acacacuguccucauccccaga

SEQ ID NO: 3443 - RNA, 20 nt, Homo sapiens
acaccacacccaucacccau

SEQ ID NO: 3444 - RNA, 22 nt, Homo sapiens
aagggguaggugugguggccaa

SEQ ID NO: 3445 - RNA, 22 nt, Homo sapiens
guggcaauacaauacaacuaca

SEQ ID NO: 3446 - RNA, 23 nt, Homo sapiens
acuauauuuguacuguauugcua

SEQ ID NO: 3447 - RNA, 22 nt, Homo sapiens
uagacacuagauaugugacuga

SEQ ID NO: 3448 - RNA, 22 nt, Homo sapiens
aaucacucacaugccuaguguc

SEQ ID NO: 3449 - RNA, 22 nt, Homo sapiens
acagcaauuaccaagugauuga

SEQ ID NO: 3450 - RNA, 25 nt, Homo sapiens
aagcagcgcccacuuccuccccgcu

SEQ ID NO: 3451 - RNA, 22 nt, Homo sapiens
agaaccucggcuggggcgggcu

SEQ ID NO: 3452 - RNA, 23 nt, Homo sapiens
ccagaacccgcccgcgccggggc

SEQ ID NO: 3453 - RNA, 22 nt, Homo sapiens
aucagagagaugccgccuugcu

SEQ ID NO: 3454 - RNA, 21 nt, Homo sapiens
aaggagcaaggcggcaucucu

SEQ ID NO: 3455 - RNA, 23 nt, Homo sapiens
gcuacagagcaccuccucuucaa

SEQ ID NO: 3456 - RNA, 22 nt, Homo sapiens
uuggagagcaagucacuguugu

SEQ ID NO: 3457 - RNA, 18 nt, Homo sapiens
aaccaccugcccucaccc

SEQ ID NO: 3458 - RNA, 18 nt, Homo sapiens
aucaagccagaagacacg

SEQ ID NO: 3459 - RNA, 23 nt, Homo sapiens
cucaugucuucuggccugaugca

SEQ ID NO: 3460 - RNA, 21 nt, Homo sapiens
auacaguacaggucucucauu

SEQ ID NO: 3461 - RNA, 22 nt, Homo sapiens
gaaaugagagaccuguacugga

SEQ ID NO: 3462 - RNA, 22 nt, Homo sapiens
uucucccacugucuggauccca

SEQ ID NO: 3463 - RNA, 22 nt, Homo sapiens
ugggagccugguagugggagaa

SEQ ID NO: 3464 - RNA, 22 nt, Homo sapiens
caacucugaccaccuagguugg

SEQ ID NO: 3465 - RNA, 22 nt, Homo sapiens
aucaaccuaaggggucagaguu

SEQ ID NO: 3466 - RNA, 23 nt, Homo sapiens
auuggcugcaguuaagguggcac

SEQ ID NO: 3467 - RNA, 22 nt, Homo sapiens
ccaccuuaacugcagccaacuu

SEQ ID NO: 3468 - RNA, 22 nt, Homo sapiens
ucuccauguuuccuucccccuu

SEQ ID NO: 3469 - RNA, 22 nt, Homo sapiens
agaagggggaaggaaacaugga

SEQ ID NO: 3470 - RNA, 21 nt, Homo sapiens
aggccacagccacccaugugu

SEQ ID NO: 3471 - RNA, 22 nt, Homo sapiens
acacauggguggcuguggccua

SEQ ID NO: 3472 - RNA, 21 nt, Homo sapiens
ugcuugguuucagguacagcu

SEQ ID NO: 3473 - RNA, 22 nt, Homo sapiens
ccugcauauuauagauuuguga

SEQ ID NO: 3474 - RNA, 21 nt, Homo sapiens
auacuugguacaacuuaagca

SEQ ID NO: 3475 - RNA, 22 nt, Homo sapiens
aaguuauaccaaauaugccagg

SEQ ID NO: 3476 - RNA, 22 nt, Homo sapiens
ccaccgucaccuggagcccuca

SEQ ID NO: 3477 - RNA, 22 nt, Homo sapiens
cugcagggaggugcuggcaggu

SEQ ID NO: 3478 - RNA, 23 nt, Homo sapiens
caaccuggcacagcccuccugcc

SEQ ID NO: 3479 - RNA, 22 nt, Homo sapiens
uuuggggaggagccagagaggg

SEQ ID NO: 3480 - RNA, 24 nt, Homo sapiens
ugcucuuaucucauggcuccccca

SEQ ID NO: 3481 - RNA, 21 nt, Homo sapiens
acuagcugaaccagaagguac

SEQ ID NO: 3482 - RNA, 23 nt, Homo sapiens
cgaagcucacuccugguucaguu

SEQ ID NO: 3483 - RNA, 22 nt, Homo sapiens
cccgacacugacgccuucccca

SEQ ID NO: 3484 - RNA, 21 nt, Homo sapiens
ggugggaaggcugcagggucu

SEQ ID NO: 3485 - RNA, 22 nt, Homo sapiens
ugcggccagagggaaccugggu

SEQ ID NO: 3486 - RNA, 23 nt, Homo sapiens
ccacuccaggcuccucuggcccu

SEQ ID NO: 3487 - RNA, 22 nt, Homo sapiens
gaaucugccagcuucccacuau

SEQ ID NO: 3488 - RNA, 21 nt, Homo sapiens
ccacuguggaagcuggcagau

SEQ ID NO: 3489 - RNA, 25 nt, Homo sapiens
cuggggcaggagggaggucagcaug

SEQ ID NO: 3490 - RNA, 23 nt, Homo sapiens
ugcuugcugccucuccccuccca

SEQ ID NO: 3491 - RNA, 22 nt, Homo sapiens
uagcuucccaacagauaaauga

SEQ ID NO: 3492 - RNA, 23 nt, Homo sapiens
uggcauggaaugggcuccgccag

SEQ ID NO: 3493 - RNA, 22 nt, Homo sapiens
aguguugggggccacuugugug

SEQ ID NO: 3494 - RNA, 22 nt, Homo sapiens
cacacucauguggcccccagca

SEQ ID NO: 3495 - RNA, 21 nt, Homo sapiens
cagaacaggacaggucagggc

SEQ ID NO: 3496 - RNA, 23 nt, Homo sapiens
agcuuccugcucccugcucuaca

SEQ ID NO: 3497 - RNA, 22 nt, Homo sapiens
aucccaaugcuagaccuggugg

SEQ ID NO: 3498 - RNA, 22 nt, Homo sapiens
caccgggucuagcauugggauu

SEQ ID NO: 3499 - RNA, 22 nt, Homo sapiens
cgcccugaccgcagcccgcagc

SEQ ID NO: 3500 - RNA, 21 nt, Homo sapiens
augucuaauuugagcaccuuu

SEQ ID NO: 3501 - RNA, 22 nt, Homo sapiens
uaccgaagguguucaaauuagg

SEQ ID NO: 3502 - RNA, 19 nt, Homo sapiens
cagcccagauaaccugccu

SEQ ID NO: 3503 - RNA, 20 nt, Homo sapiens
cacugucagcauccucgcau

SEQ ID NO: 3504 - RNA, 22 nt, Homo sapiens
uccuccaggcgcuccaguuuca

SEQ ID NO: 3505 - RNA, 22 nt, Homo sapiens
augaaacugaaaacgcgcuggu

SEQ ID NO: 3506 - RNA, 25 nt, Homo sapiens
agggccccuccgcuccuccucccuu

SEQ ID NO: 3507 - RNA, 22 nt, Homo sapiens
gcagggacggauccucucgggc

SEQ ID NO: 3508 - RNA, 22 nt, Homo sapiens
ccugcccgagaggaucaguccu

SEQ ID NO: 3509 - RNA, 23 nt, Homo sapiens
agccgaccccuccggacagcccg

SEQ ID NO: 3510 - RNA, 23 nt, Homo sapiens
cugcaggcaaaggagaauacaga

SEQ ID NO: 3511 - RNA, 23 nt, Homo sapiens
ucuguaaauaucccuuugccuga

SEQ ID NO: 3512 - RNA, 21 nt, Homo sapiens
cuggaccagaaaagacagaaa

SEQ ID NO: 3513 - RNA, 23 nt, Homo sapiens
augccuccugucccauccggcca

SEQ ID NO: 3514 - RNA, 23 nt, Homo sapiens
cauagcgaagucuagucuuuaga

SEQ ID NO: 3515 - RNA, 23 nt, Homo sapiens
gaccgugagacgucgccgggcca

SEQ ID NO: 3516 - RNA, 23 nt, Homo sapiens
cgccgucccgggagccccacuca

SEQ ID NO: 3517 - RNA, 21 nt, Homo sapiens
ucggcccgcaggagcaccgcu

SEQ ID NO: 3518 - RNA, 23 nt, Homo sapiens
ucugcagguucuccugggaccgg

SEQ ID NO: 3519 - RNA, 22 nt, Homo sapiens
cugggaggaaagcccgggccuu

SEQ ID NO: 3520 - RNA, 22 nt, Homo sapiens
cuaagaccaagccuccuucccu

SEQ ID NO: 3521 - RNA, 21 nt, Homo sapiens
agcaaauccuccccaaaccuc

SEQ ID NO: 3522 - RNA, 20 nt, Homo sapiens
cugugggggcaggaggggcg

SEQ ID NO: 3523 - RNA, 22 nt, Homo sapiens
gaugcccuggccuguccccgca

SEQ ID NO: 3524 - RNA, 22 nt, Homo sapiens
cugcgggagggggugggucagg

SEQ ID NO: 3525 - RNA, 22 nt, Homo sapiens
cacucaaccaccuccgcccgag

SEQ ID NO: 3526 - RNA, 24 nt, Homo sapiens
ccuucuagcagcuacggguccucu

SEQ ID NO: 3527 - RNA, 22 nt, Homo sapiens
agcacauccuugagauccacaa

SEQ ID NO: 3528 - RNA, 22 nt, Homo sapiens
acacaaggcuaaagaaagagaa

SEQ ID NO: 3529 - RNA, 22 nt, Homo sapiens
cuguucucuuccuuuggccuug

SEQ ID NO: 3530 - RNA, 23 nt, Homo sapiens
acuccgcuaacccagguccgcau

SEQ ID NO: 3531 - RNA, 22 nt, Homo sapiens
acuuucccuucagagccuggcu

SEQ ID NO: 3532 - RNA, 22 nt, Homo sapiens
aaagccaggcucugaagggaaa

SEQ ID NO: 3533 - RNA, 22 nt, Homo sapiens
auaggaaggcaaccaucucugg

SEQ ID NO: 3534 - RNA, 23 nt, Homo sapiens
agcagagagugagcgccucccug

SEQ ID NO: 3535 - RNA, 22 nt, Homo sapiens
gcgaagccucugugacgucaug

SEQ ID NO: 3536 - RNA, 23 nt, Homo sapiens
acaccgugacgucacagaggccu

SEQ ID NO: 3537 - RNA, 23 nt, Homo sapiens
gaggguggucagcagguggggca

SEQ ID NO: 3538 - RNA, 23 nt, Homo sapiens
cagccccaccggcucccacucac

SEQ ID NO: 3539 - RNA, 21 nt, Homo sapiens
uaauuccaacaucuaguccua

SEQ ID NO: 3540 - RNA, 22 nt, Homo sapiens
gguuuagauugaacaugaauuu

SEQ ID NO: 3541 - RNA, 22 nt, Homo sapiens
cuaacuucauguucaaucuaaa

SEQ ID NO: 3542 - RNA, 21 nt, Homo sapiens
ggacaaagugcgcaugcccuc

SEQ ID NO: 3543 - RNA, 21 nt, Homo sapiens
ggucaggcaugcacaccuugu

SEQ ID NO: 3544 - RNA, 22 nt, Homo sapiens
caccacaaaucuugaucagaag

SEQ ID NO: 3545 - RNA, 21 nt, Homo sapiens
aggcuucugaucaagauuugg

SEQ ID NO: 3546 - RNA, 24 nt, Homo sapiens
cccgcccagcaccagccccugccu

SEQ ID NO: 3547 - RNA, 21 nt, Homo sapiens
agcaggagggcugggcaggcg

SEQ ID NO: 3548 - RNA, 22 nt, Homo sapiens
ccaugggugugaaaggaguuaa

SEQ ID NO: 3549 - RNA, 21 nt, Homo sapiens
agauaacuccuuccacaucca

SEQ ID NO: 3550 - RNA, 22 nt, Homo sapiens
gaacauagcuaucaaucacuca

SEQ ID NO: 3551 - RNA, 21 nt, Homo sapiens
uuccaaaagagcaauugcuau

SEQ ID NO: 3552 - RNA, 21 nt, Homo sapiens
aacaccaacugcucuuucaga

SEQ ID NO: 3553 - RNA, 23 nt, Homo sapiens
ggcggcggccaggagcgcccgcg

SEQ ID NO: 3554 - RNA, 20 nt, Homo sapiens
auucucucuggaucuccugg

SEQ ID NO: 3555 - RNA, 22 nt, Homo sapiens
auccaugggauccagagagaau

SEQ ID NO: 3556 - RNA, 22 nt, Homo sapiens
guaggggagggaggauggcaga

SEQ ID NO: 3557 - RNA, 24 nt, Homo sapiens
cucauaccuucucuccaucccacc

SEQ ID NO: 3558 - RNA, 18 nt, Homo sapiens
agcuacagugucaucuca

SEQ ID NO: 3559 - RNA, 21 nt, Homo sapiens
uaauuguaggucaagucugcu

SEQ ID NO: 3560 - RNA, 22 nt, Homo sapiens
ucugaucaggcaaaguugcagg

SEQ ID NO: 3561 - RNA, 22 nt, Homo sapiens
agucugcaauuuugccugauca

SEQ ID NO: 3562 - RNA, 22 nt, Homo sapiens
gccuuucuaugcuccuguucug

SEQ ID NO: 3563 - RNA, 21 nt, Homo sapiens
uucuggcacauguuaggcaau

SEQ ID NO: 3564 - RNA, 22 nt, Homo sapiens
uuauuaccuacuacauaccaga

SEQ ID NO: 3565 - RNA, 22 nt, Homo sapiens
agugaccgaaacaaaaaauuaa

SEQ ID NO: 3566 - RNA, 23 nt, Homo sapiens
augcaguggaccaggauggcaag

SEQ ID NO: 3567 - RNA, 22 nt, Homo sapiens
agcccuugccauccugguccac

SEQ ID NO: 3568 - RNA, 22 nt, Homo sapiens
uacagcauucuagaugagguau

SEQ ID NO: 3569 - RNA, 22 nt, Homo sapiens
uauauauaucucucaucuagaa

SEQ ID NO: 3570 - RNA, 22 nt, Homo sapiens
ucaacucugcaaaggaagaaga

SEQ ID NO: 3571 - RNA, 22 nt, Homo sapiens
ccucuucuuccuuuacagaauu

SEQ ID NO: 3572 - RNA, 22 nt, Homo sapiens
cugcuuuuacuauucccuccua

SEQ ID NO: 3573 - RNA, 22 nt, Homo sapiens
gcuagggaucaggcucaagggu

SEQ ID NO: 3574 - RNA, 22 nt, Homo sapiens
cucuagcgaggauuccaacauu

SEQ ID NO: 3575 - RNA, 21 nt, Homo sapiens
ccaauauuggaauccccgcua

SEQ ID NO: 3576 - RNA, 22 nt, Homo sapiens
guucuagauaugaagacaauca

SEQ ID NO: 3577 - RNA, 22 nt, Homo sapiens
uugauugucuucauauccagaa

SEQ ID NO: 3578 - RNA, 23 nt, Homo sapiens
gcagacgcgccccaacaccgggg

SEQ ID NO: 3579 - RNA, 21 nt, Homo sapiens
agcccgggagcugggcgcgcc

SEQ ID NO: 3580 - RNA, 20 nt, Homo sapiens
ucagucccagcaucuccuca

SEQ ID NO: 3581 - RNA, 21 nt, Homo sapiens
gcuggcggcgucgccgacucu

SEQ ID NO: 3582 - RNA, 22 nt, Homo sapiens
gcccagaccagagcuggcuuca

SEQ ID NO: 3583 - RNA, 22 nt, Homo sapiens
ggugcauccaguccuggucuca

SEQ ID NO: 3584 - RNA, 24 nt, Homo sapiens
gcgcggggcagugggcggcgcauc

SEQ ID NO: 3585 - RNA, 22 nt, Homo sapiens
gggaugccgccgccacccccgc

SEQ ID NO: 3586 - RNA, 22 nt, Homo sapiens
gccucccuuagcugguccguaa

SEQ ID NO: 3587 - RNA, 21 nt, Homo sapiens
uauauacaccugcuaugugug

SEQ ID NO: 3588 - RNA, 22 nt, Homo sapiens
cauacacauaucagguguauac

SEQ ID NO: 3589 - RNA, 22 nt, Homo sapiens
ugugacaucgcuuuaccauuca

SEQ ID NO: 3590 - RNA, 20 nt, Homo sapiens
aacaugaaugguaaagcgau

SEQ ID NO: 3591 - RNA, 18 nt, Homo sapiens
uuucagucaucauaucca

SEQ ID NO: 3592 - RNA, 18 nt, Homo sapiens
gccagcgagcgcucaccg

SEQ ID NO: 3593 - RNA, 23 nt, Homo sapiens
agccagccaacucacagugcaga

SEQ ID NO: 3594 - RNA, 24 nt, Homo sapiens
ccucugcccuguggagcaggaugu

SEQ ID NO: 3595 - RNA, 22 nt, Homo sapiens
acagucucgugagauagccaga

SEQ ID NO: 3596 - RNA, 22 nt, Homo sapiens
auccagaaguggcuaauaauau

SEQ ID NO: 3597 - RNA, 21 nt, Homo sapiens
ucaauauuauuagccacuucu

SEQ ID NO: 3598 - RNA, 22 nt, Homo sapiens
gugucuauacucugccacuuua

SEQ ID NO: 3599 - RNA, 22 nt, Homo sapiens
guaaagugacagaguauagaca

SEQ ID NO: 3600 - RNA, 21 nt, Homo sapiens
acagagugccacuuacugaga

SEQ ID NO: 3601 - RNA, 21 nt, Homo sapiens
uucaguaaguggcacucuguc

SEQ ID NO: 3602 - RNA, 22 nt, Homo sapiens
acuucgguauacuucgugaguu

SEQ ID NO: 3603 - RNA, 22 nt, Homo sapiens
ccaauucacaaaguauaccgaa

SEQ ID NO: 3604 - RNA, 22 nt, Homo sapiens
uauauaaaugcagcaugccagu

SEQ ID NO: 3605 - RNA, 22 nt, Homo sapiens
gacuggcaugcugcauuuagau

SEQ ID NO: 3606 - RNA, 19 nt, Homo sapiens
guggacagacggacggaug

SEQ ID NO: 3607 - RNA, 21 nt, Homo sapiens
uccuuccuuccucgguccacu

SEQ ID NO: 3608 - RNA, 22 nt, Homo sapiens
ugagccuugguuuucuugugua

SEQ ID NO: 3609 - RNA, 23 nt, Homo sapiens
gcuugaagguuuccauccaugua

SEQ ID NO: 3610 - RNA, 22 nt, Homo sapiens
aacauggucuagaaccuccaua

SEQ ID NO: 3611 - RNA, 21 nt, Homo sapiens
ucaauccacacuauuauguua

SEQ ID NO: 3612 - RNA, 21 nt, Homo sapiens
uuucgagggcaagguuaagca

SEQ ID NO: 3613 - RNA, 21 nt, Homo sapiens
uugcuuaaccuuaccguccaa

SEQ ID NO: 3614 - RNA, 21 nt, Homo sapiens
aagacgggaggagaggaguga

SEQ ID NO: 3615 - RNA, 22 nt, Homo sapiens
cucccuucuuuccucccgucuu

SEQ ID NO: 3616 - RNA, 22 nt, Homo sapiens
aucgggaggggacugagccuga

SEQ ID NO: 3617 - RNA, 22 nt, Homo sapiens
agagaggagagccguguaugac

SEQ ID NO: 3618 - RNA, 22 nt, Homo sapiens
gaauucaucacggccagccucu

SEQ ID NO: 3619 - RNA, 21 nt, Homo sapiens
auccuguacugagcugccccg

SEQ ID NO: 3620 - RNA, 22 nt, Homo sapiens
cucggggcagcucaguacagga

SEQ ID NO: 3621 - RNA, 22 nt, Homo sapiens
aacuggaugucccuguaugauu

SEQ ID NO: 3622 - RNA, 22 nt, Homo sapiens
aaguggaugacccuguacgauu

SEQ ID NO: 3623 - RNA, 21 nt, Homo sapiens
gaccaagaaauagccuuucaa

SEQ ID NO: 3624 - RNA, 21 nt, Homo sapiens
uugagagugccauuaucuggg

SEQ ID NO: 3625 - RNA, 22 nt, Homo sapiens
gcugccguauaugugaugucac

SEQ ID NO: 3626 - RNA, 22 nt, Homo sapiens
cagcauggaguccuccagguug

SEQ ID NO: 3627 - RNA, 20 nt, Homo sapiens
acccaccuggagauccaugg

SEQ ID NO: 3628 - RNA, 22 nt, Homo sapiens
guagaagggaaucuugcauaag

SEQ ID NO: 3629 - RNA, 22 nt, Homo sapiens
ccucauggaaggguuccccacu

SEQ ID NO: 3630 - RNA, 23 nt, Homo sapiens
aagaaucuugucccgcagguccu

SEQ ID NO: 3631 - RNA, 22 nt, Homo sapiens
ccuggcacacaguagaccuuca

SEQ ID NO: 3632 - RNA, 22 nt, Homo sapiens
aaugaaagccuaccauguacaa

SEQ ID NO: 3633 - RNA, 22 nt, Homo sapiens
gagguuucccguguauguuuca

SEQ ID NO: 3634 - RNA, 22 nt, Homo sapiens
aagaagugcaccauguuuguuu

SEQ ID NO: 3635 - RNA, 22 nt, Homo sapiens
cgaaaauaacaugggcaacuuc

SEQ ID NO: 3636 - RNA, 22 nt, Homo sapiens
gagauuggccauguaauacuca

SEQ ID NO: 3637 - RNA, 22 nt, Homo sapiens
ucuaacaccacagugugguuug

SEQ ID NO: 3638 - RNA, 21 nt, Homo sapiens
acaaaccacagugugcugcug

SEQ ID NO: 3639 - RNA, 23 nt, Homo sapiens
gaaaaacgcccccuggcuugaaa

SEQ ID NO: 3640 - RNA, 20 nt, Homo sapiens
acuguauugucagguaguga

SEQ ID NO: 3641 - RNA, 21 nt, Homo sapiens
ucacuaccugacaauacagca

SEQ ID NO: 3642 - RNA, 22 nt, Homo sapiens
agcacagacuugcugugauguu

SEQ ID NO: 3643 - RNA, 21 nt, Homo sapiens
aaacaucacugcaagucuuaa

SEQ ID NO: 3644 - RNA, 22 nt, Homo sapiens
uguuaagacuugcagugauguu

SEQ ID NO: 3645 - RNA, 21 nt, Homo sapiens
ugaacaucacagcaagucugu

SEQ ID NO: 3646 - RNA, 22 nt, Homo sapiens
uccaaguucagaaguguccuga

SEQ ID NO: 3647 - RNA, 22 nt, Homo sapiens
acucaggaacacuucugaacug

SEQ ID NO: 3648 - RNA, 22 nt, Homo sapiens
aaggaccuggacagaggcagaa

SEQ ID NO: 3649 - RNA, 24 nt, Homo sapiens
agcuccgccgcugaguccagcccu

SEQ ID NO: 3650 - RNA, 21 nt, Homo sapiens
aaguggucagugaggcaguca

SEQ ID NO: 3651 - RNA, 24 nt, Homo sapiens
acuaagugccucagaaaccaaauu

SEQ ID NO: 3652 - RNA, 21 nt, Homo sapiens
ccccaacaaccuagaaaagua

SEQ ID NO: 3653 - RNA, 23 nt, Homo sapiens
ucuacccugcaagguuguuguga

SEQ ID NO: 3654 - RNA, 22 nt, Homo sapiens
cugaggcccaggaaaauccaag

SEQ ID NO: 3655 - RNA, 22 nt, Homo sapiens
ucgugaauuugcccuguccuca

SEQ ID NO: 3656 - RNA, 21 nt, Homo sapiens
cugccaggauggaaagggaaa

SEQ ID NO: 3657 - RNA, 21 nt, Homo sapiens
uuccaccuccugcccuggcaa

SEQ ID NO: 3658 - RNA, 22 nt, Homo sapiens
auuagaguuugguucauaugau

SEQ ID NO: 3659 - RNA, 22 nt, Homo sapiens
aaaccauaucagccagacucua

SEQ ID NO: 3660 - RNA, 21 nt, Homo sapiens
gcgaggcccugggagcacagg

SEQ ID NO: 3661 - RNA, 22 nt, Homo sapiens
ccacugugccccaagggccuca

SEQ ID NO: 3662 - RNA, 22 nt, Homo sapiens
uuuuggacuuucagauuuagga

SEQ ID NO: 3663 - RNA, 24 nt, Homo sapiens
auccccaaaucugaaaaaguccaa

SEQ ID NO: 3664 - RNA, 22 nt, Homo sapiens
cagaauccuugcccaggugcau

SEQ ID NO: 3665 - RNA, 23 nt, Homo sapiens
ucucacccagguagcaaggauua

SEQ ID NO: 3666 - RNA, 18 nt, Homo sapiens
acccagguagcaaggauu

SEQ ID NO: 3667 - RNA, 22 nt, Homo sapiens
cuggggaaugggagacacaaaa

SEQ ID NO: 3668 - RNA, 22 nt, Homo sapiens
aauuuugcucugccaucccccu

SEQ ID NO: 3669 - RNA, 22 nt, Homo sapiens
uguuauauauacagccaugcac

SEQ ID NO: 3670 - RNA, 21 nt, Homo sapiens
gagugcauggcuguauauaua

SEQ ID NO: 3671 - RNA, 22 nt, Homo sapiens
agaauccuugcccgggugcauu

SEQ ID NO: 3672 - RNA, 22 nt, Homo sapiens
ucucacccagggacaaaggauu

SEQ ID NO: 3673 - RNA, 22 nt, Homo sapiens
ugaauccuugcccaggugcauu

SEQ ID NO: 3674 - RNA, 21 nt, Homo sapiens
uagcacccagauagcaaggau

SEQ ID NO: 3675 - RNA, 23 nt, Homo sapiens
ccuggcagcggaaacaauacccc

SEQ ID NO: 3676 - RNA, 23 nt, Homo sapiens
cugcagaacuguucccgcugcua

SEQ ID NO: 3677 - RNA, 22 nt, Homo sapiens
gauagagugcagaccagggucu

SEQ ID NO: 3678 - RNA, 21 nt, Homo sapiens
accuuacaaccgcagcugcaa

SEQ ID NO: 3679 - RNA, 22 nt, Homo sapiens
aggaaaccagcaaguguugacg

SEQ ID NO: 3680 - RNA, 22 nt, Homo sapiens
acaucaauacuuccuggcuccc

SEQ ID NO: 3681 - RNA, 21 nt, Homo sapiens
ucuacucagaagggugccuua

SEQ ID NO: 3682 - RNA, 22 nt, Homo sapiens
uuaaguaacaccuuccugaaua

SEQ ID NO: 3683 - RNA, 21 nt, Homo sapiens
uucacuccaaaaggugcaaaa

SEQ ID NO: 3684 - RNA, 23 nt, Homo sapiens
ucuacuccaaaaggcuacaauca

SEQ ID NO: 3685 - RNA, 23 nt, Homo sapiens
caugagugacgcccucuggagua

SEQ ID NO: 3686 - RNA, 23 nt, Homo sapiens
caugccagcaaagcuacaaaccc

SEQ ID NO: 3687 - RNA, 23 nt, Homo sapiens
cuccauccaaucccugagcccug

SEQ ID NO: 3688 - RNA, 23 nt, Homo sapiens
ucagugggauuuccgaguagcau

SEQ ID NO: 3689 - RNA, 21 nt, Homo sapiens
gaugcuacucagaaaucccac

SEQ ID NO: 3690 - RNA, 23 nt, Homo sapiens
cacccuacaccaaucugccccgg

SEQ ID NO: 3691 - RNA, 23 nt, Homo sapiens
cagcacagucuugucgucuccgu

SEQ ID NO: 3692 - RNA, 22 nt, Homo sapiens
gaugccaagcucagcguggauu

SEQ ID NO: 3693 - RNA, 23 nt, Homo sapiens
gcuccuagccagccucauuuccu

SEQ ID NO: 3694 - RNA, 22 nt, Homo sapiens
caugauugccacgucugcagua

SEQ ID NO: 3695 - RNA, 22 nt, Homo sapiens
cuacccacagacguaccaauca

SEQ ID NO: 3696 - RNA, 22 nt, Homo sapiens
agguucaaggcauucacugauu

SEQ ID NO: 3697 - RNA, 21 nt, Homo sapiens
cgcggugguucacgccuguaa

SEQ ID NO: 3698 - RNA, 21 nt, Homo sapiens
ugauugccacugucugcagua

SEQ ID NO: 3699 - RNA, 21 nt, Homo sapiens
gccugaccaacauggugaaac

SEQ ID NO: 3700 - RNA, 22 nt, Homo sapiens
gugauugccacucuccugagua

SEQ ID NO: 3701 - RNA, 22 nt, Homo sapiens
agaggcaccgcugggaucugaa

SEQ ID NO: 3702 - RNA, 21 nt, Homo sapiens
ugacugcagagcaaaagacac

SEQ ID NO: 3703 - RNA, 22 nt, Homo sapiens
gaccucagcuaugacagcacuu

SEQ ID NO: 3704 - RNA, 23 nt, Homo sapiens
gaaagugcccucaaggcugagug

SEQ ID NO: 3705 - RNA, 23 nt, Homo sapiens
ccuucucagaaaggugaaauuua

SEQ ID NO: 3706 - RNA, 18 nt, Homo sapiens
augacaccucccugugaa

SEQ ID NO: 3707 - RNA, 22 nt, Homo sapiens
auaaaugacaccuccuugugaa

SEQ ID NO: 3708 - RNA, 23 nt, Homo sapiens
ucuucucagaaaggugaaauuua

SEQ ID NO: 3709 - RNA, 22 nt, Homo sapiens
auaaacgacaccuccuugagaa

SEQ ID NO: 3710 - RNA, 21 nt, Homo sapiens
ucuacucacagaagugucaau

SEQ ID NO: 3711 - RNA, 23 nt, Homo sapiens
caugauugucacucuccagagua

SEQ ID NO: 3712 - RNA, 21 nt, Homo sapiens
uccacucacagaggugucaau

SEQ ID NO: 3713 - RNA, 22 nt, Homo sapiens
augauugccucccucuugagaa

SEQ ID NO: 3714 - RNA, 22 nt, Homo sapiens
aacgcuccaaaagaaggcacuc

SEQ ID NO: 3715 - RNA, 24 nt, Homo sapiens
cagaaagugcuuucuuuuggagaa

SEQ ID NO: 3716 - RNA, 18 nt, Homo sapiens
acccucugaaaggaagca

SEQ ID NO: 3717 - RNA, 23 nt, Homo sapiens
gaaagugcuucuuuccucgagaa

SEQ ID NO: 3718 - RNA, 18 nt, Homo sapiens
acccucugaaaggaagca

SEQ ID NO: 3719 - RNA, 22 nt, Homo sapiens
aaagugcuucuuaccuccagau

SEQ ID NO: 3720 - RNA, 22 nt, Homo sapiens
agacagugcuuccaucuagagg

SEQ ID NO: 3721 - RNA, 22 nt, Homo sapiens
acacucuaaagggaugcacgau

SEQ ID NO: 3722 - RNA, 22 nt, Homo sapiens
acacucuaaagggaugcacgau

SEQ ID NO: 3723 - RNA, 22 nt, Homo sapiens
acacucuaaaaggaugcacgau

SEQ ID NO: 3724 - RNA, 21 nt, Homo sapiens
accugauuucuaccaaucucu

SEQ ID NO: 3725 - RNA, 21 nt, Homo sapiens
cugaggaaaagaggauucagu

SEQ ID NO: 3726 - RNA, 22 nt, Homo sapiens
uccacuucaaucccucauccca

SEQ ID NO: 3727 - RNA, 23 nt, Homo sapiens
cuccgguuuaaauggguccgauu

SEQ ID NO: 3728 - RNA, 24 nt, Homo sapiens
ccuguccauccgccugugcccaga

SEQ ID NO: 3729 - RNA, 22 nt, Homo sapiens
uccagcaaagggaagcgcuuuc

SEQ ID NO: 3730 - RNA, 20 nt, Homo sapiens
gaaagggcuucccuuugcag

SEQ ID NO: 3731 - RNA, 22 nt, Homo sapiens
accucuaaaggggagcgcuuug

SEQ ID NO: 3732 - RNA, 23 nt, Homo sapiens
acacucuaaagagaagcgcuuug

SEQ ID NO: 3733 - RNA, 23 nt, Homo sapiens
cagaaagugcuucccuccagaga

SEQ ID NO: 3734 - RNA, 21 nt, Homo sapiens
gcuccaaagggaagcgcuuug

SEQ ID NO: 3735 - RNA, 22 nt, Homo sapiens
cagaaagugcuucccucuagag

SEQ ID NO: 3736 - RNA, 21 nt, Homo sapiens
cacucugaagggaagcgcuuu

SEQ ID NO: 3737 - RNA, 22 nt, Homo sapiens
cagaaagcgcuucccucuagag

SEQ ID NO: 3738 - RNA, 21 nt, Homo sapiens
ccucuaaagagaagcgcuuuc

SEQ ID NO: 3739 - RNA, 22 nt, Homo sapiens
gagaaagugcuucccucuagag

SEQ ID NO: 3740 - RNA, 21 nt, Homo sapiens
uggcuccagcucagucacugg

SEQ ID NO: 3741 - RNA, 22 nt, Homo sapiens
agcacuucauucuuccuauccu

SEQ ID NO: 3742 - RNA, 22 nt, Homo sapiens
accaccuggaauccacucuccu

SEQ ID NO: 3743 - RNA, 22 nt, Homo sapiens
acugggaugagguagaggagga

SEQ ID NO: 3744 - RNA, 22 nt, Homo sapiens
ccaucccauuccaaaccccuca

SEQ ID NO: 3745 - RNA, 21 nt, Homo sapiens
agcccccucagagaacuggau

SEQ ID NO: 3746 - RNA, 22 nt, Homo sapiens
ccauccaguugccuuagggguu

SEQ ID NO: 3747 - RNA, 21 nt, Homo sapiens
cugggagggagacgaggauga

SEQ ID NO: 3748 - RNA, 22 nt, Homo sapiens
cccaacccucguccccuucccu

SEQ ID NO: 3749 - RNA, 23 nt, Homo sapiens
auucgaugacucagucucuucuu

SEQ ID NO: 3750 - RNA, 23 nt, Homo sapiens
ucaagaaugaguuugugccauug

SEQ ID NO: 3751 - RNA, 22 nt, Homo sapiens
acacucuaaaaggaugcacuuu

SEQ ID NO: 3752 - RNA, 22 nt, Homo sapiens
cagaaagcgcuucccucuagag

SEQ ID NO: 3753 - RNA, 22 nt, Homo sapiens
aaccucuaaaaggaugcacuuu

SEQ ID NO: 3754 - RNA, 22 nt, Homo sapiens
cagaaagcgcuucccucuagag

SEQ ID NO: 3755 - RNA, 22 nt, Homo sapiens
auccucuaaaaagaugcacuuu

SEQ ID NO: 3756 - RNA, 22 nt, Homo sapiens
cagaaagcgcuucccucuagag

SEQ ID NO: 3757 - RNA, 22 nt, Homo sapiens
cacucuaaagggaggcacuuug

SEQ ID NO: 3758 - RNA, 22 nt, Homo sapiens
aacacucuaaaaggaggcacuu

SEQ ID NO: 3759 - RNA, 22 nt, Homo sapiens
gaaagugcucccuuuuggagaa

SEQ ID NO: 3760 - RNA, 22 nt, Homo sapiens
acaguccaaagggaagcacuuu

SEQ ID NO: 3761 - RNA, 21 nt, Homo sapiens
agaaaguacuucccucuggag

SEQ ID NO: 3762 - RNA, 21 nt, Homo sapiens
cccucuaaaaggaagcacuuu

SEQ ID NO: 3763 - RNA, 22 nt, Homo sapiens
acccucuaaaaggaagcacuuu

SEQ ID NO: 3764 - RNA, 22 nt, Homo sapiens
cagaaagugcuucccucuagag

SEQ ID NO: 3765 - RNA, 22 nt, Homo sapiens
acccaccaaagagaagcacuuu

SEQ ID NO: 3766 - RNA, 20 nt, Homo sapiens
gaaagggcuucccuuuguag

SEQ ID NO: 3767 - RNA, 21 nt, Homo sapiens
cccucaaaaaggaagcacuuu

SEQ ID NO: 3768 - RNA, 22 nt, Homo sapiens
aacccucuaaaaggaagcacuu

SEQ ID NO: 3769 - RNA, 24 nt, Homo sapiens
acacucuaaagggaagcacuuugu

SEQ ID NO: 3770 - RNA, 22 nt, Homo sapiens
acucuaaagggaagcacuuugu

SEQ ID NO: 3771 - RNA, 22 nt, Homo sapiens
acacucuaaagggaagugcguu

SEQ ID NO: 3772 - RNA, 22 nt, Homo sapiens
acacucuaaagggaaccauuuu

SEQ ID NO: 3773 - RNA, 22 nt, Homo sapiens
cagaaagcgcuucccucuagag

SEQ ID NO: 3774 - RNA, 23 nt, Homo sapiens
acccucuauagggaagcgcguuc

SEQ ID NO: 3775 - RNA, 22 nt, Homo sapiens
cagaaagcgcuucccucuagag

SEQ ID NO: 3776 - RNA, 21 nt, Homo sapiens
acuccaaagggaagcgccuuc

SEQ ID NO: 3777 - RNA, 22 nt, Homo sapiens
gagaaagugcuucccuuuguag

SEQ ID NO: 3778 - RNA, 22 nt, Homo sapiens
cgcucuaaagggaagcgccuuc

SEQ ID NO: 3779 - RNA, 21 nt, Homo sapiens
agaaagugcaucccucuggag

SEQ ID NO: 3780 - RNA, 22 nt, Homo sapiens
cagaaagugcuucccucuagag

SEQ ID NO: 3781 - RNA, 22 nt, Homo sapiens
gccucuaaaaggaagcacuuuc

SEQ ID NO: 3782 - RNA, 23 nt, Homo sapiens
acagaaagugcuucccucaagag

SEQ ID NO: 3783 - RNA, 20 nt, Homo sapiens
gaaagggcuucccuuugcag

SEQ ID NO: 3784 - RNA, 22 nt, Homo sapiens
ugcaagccuugggugugggagg

SEQ ID NO: 3785 - RNA, 22 nt, Homo sapiens
acgguccuacacucaaggcaug

SEQ ID NO: 3786 - RNA, 22 nt, Homo sapiens
aaagaaauuguccuuguaugau

SEQ ID NO: 3787 - RNA, 22 nt, Homo sapiens
acacaccaaggauaauuucucc

SEQ ID NO: 3788 - RNA, 22 nt, Homo sapiens
aguccagauucugugcccacca

SEQ ID NO: 3789 - RNA, 25 nt, Homo sapiens
agugggaccgacagcagaauccuuu

SEQ ID NO: 3790 - RNA, 22 nt, Homo sapiens
uuucaguuaucaaucugucaca

SEQ ID NO: 3791 - RNA, 23 nt, Homo sapiens
ucucgugacaugaugauccccga

SEQ ID NO: 3792 - RNA, 22 nt, Homo sapiens
aagaagugcaccgcgaauguuu

SEQ ID NO: 3793 - RNA, 22 nt, Homo sapiens
gaacuugcuaaaaaugcagaau

SEQ ID NO: 3794 - RNA, 22 nt, Homo sapiens
uuagaaaugcacaaccucaggu

SEQ ID NO: 3795 - RNA, 22 nt, Homo sapiens
gcacacaauaaauguuugcuga

SEQ ID NO: 3796 - RNA, 22 nt, Homo sapiens
ucaucuaauaaacauuuacuga

SEQ ID NO: 3797 - RNA, 22 nt, Homo sapiens
uggugcaaaaguaacuguagcu

SEQ ID NO: 3798 - RNA, 20 nt, Homo sapiens
gaaaguaauugcaguuuuua

SEQ ID NO: 3799 - RNA, 23 nt, Homo sapiens
caaaaacugcaauuacuuuugca

SEQ ID NO: 3800 - RNA, 22 nt, Homo sapiens
uggcaaaaccgcaauuacuucu

SEQ ID NO: 3801 - RNA, 22 nt, Homo sapiens
gcaaaaguaauugccaguuuug

SEQ ID NO: 3802 - RNA, 22 nt, Homo sapiens
gguaaaacucgcaauuacuuuu

SEQ ID NO: 3803 - RNA, 25 nt, Homo sapiens
uggugcaaaaguaauugugguuuuu

SEQ ID NO: 3804 - RNA, 22 nt, Homo sapiens
agcaaaauccacaauuacuuuu

SEQ ID NO: 3805 - RNA, 22 nt, Homo sapiens
caaaaguaauugccgguuuuug

SEQ ID NO: 3806 - RNA, 22 nt, Homo sapiens
ugcaaaagucauugucguuuuc

SEQ ID NO: 3807 - RNA, 21 nt, Homo sapiens
ugaaaguaauugcaguuuuug

SEQ ID NO: 3808 - RNA, 21 nt, Homo sapiens
gcagaaaccacaauuaccuuu

SEQ ID NO: 3809 - RNA, 22 nt, Homo sapiens
gcaaaaguaacugcaguuuuug

SEQ ID NO: 3810 - RNA, 20 nt, Homo sapiens
caaacacugcaaucacuuuu

SEQ ID NO: 3811 - RNA, 22 nt, Homo sapiens
gggaaaaacugcaauuaccuuu

SEQ ID NO: 3812 - RNA, 21 nt, Homo sapiens
uaaaaguaauugcaguuuuua

SEQ ID NO: 3813 - RNA, 23 nt, Homo sapiens
caaaaacugcaauuacuuuugca

SEQ ID NO: 3814 - RNA, 21 nt, Homo sapiens
ucaaaaaccgcaguuacuuuu

SEQ ID NO: 3815 - RNA, 22 nt, Homo sapiens
ugguacaaaagucauugccguu

SEQ ID NO: 3816 - RNA, 22 nt, Homo sapiens
acaaaaguaacugcaguuuuug

SEQ ID NO: 3817 - RNA, 22 nt, Homo sapiens
ggcaaaaaccgcaauuacuuuu

SEQ ID NO: 3818 - RNA, 20 nt, Homo sapiens
caaaaaccacaaugccuuuu

SEQ ID NO: 3819 - RNA, 22 nt, Homo sapiens
ugcaaaaguagucacggucuuu

SEQ ID NO: 3820 - RNA, 22 nt, Homo sapiens
ugcaaaaaccguaguuacuucu

SEQ ID NO: 3821 - RNA, 19 nt, Homo sapiens
aaaaguaauugugguuuuu

SEQ ID NO: 3822 - RNA, 19 nt, Homo sapiens
aaagaccgcaauuacuuuu

SEQ ID NO: 3823 - RNA, 22 nt, Homo sapiens
gcaaaaguaauugcaguuuuug

SEQ ID NO: 3824 - RNA, 22 nt, Homo sapiens
ggcaaaaacagcaauuacuuuc

SEQ ID NO: 3825 - RNA, 21 nt, Homo sapiens
gcaaaaauaacugcaguuuua

SEQ ID NO: 3826 - RNA, 21 nt, Homo sapiens
gcaaaaacugcaauuacuuuu

SEQ ID NO: 3827 - RNA, 22 nt, Homo sapiens
acaaacauaauuguggguuuua

SEQ ID NO: 3828 - RNA, 22 nt, Homo sapiens
ggcaaaacccgcaauuacuuuu

SEQ ID NO: 3829 - RNA, 21 nt, Homo sapiens
acaaaaguuacugcgguuuug

SEQ ID NO: 3830 - RNA, 22 nt, Homo sapiens
agccaaaaccgcaauaacuuuu

SEQ ID NO: 3831 - RNA, 21 nt, Homo sapiens
cuggugcaaaaguaacugcca

SEQ ID NO: 3832 - RNA, 21 nt, Homo sapiens
gcaaaaaccgcaauuacuuuu

SEQ ID NO: 3833 - RNA, 20 nt, Homo sapiens
gcaaaaguaacugcaguuuu

SEQ ID NO: 3834 - RNA, 18 nt, Homo sapiens
aaauccgcaaguacuuuu

SEQ ID NO: 3835 - RNA, 20 nt, Homo sapiens
aaccgugaugacuuuugcac

SEQ ID NO: 3836 - RNA, 22 nt, Homo sapiens
ugcaagaguaaucgcgguuuug

SEQ ID NO: 3837 - RNA, 21 nt, Homo sapiens
gcaaaaaccacaauuacuuuu

SEQ ID NO: 3838 - RNA, 21 nt, Homo sapiens
gcaaaagugauugcaguuuuu

SEQ ID NO: 3839 - RNA, 22 nt, Homo sapiens
gcaaaaaccacaaucacuuuug

SEQ ID NO: 3840 - RNA, 22 nt, Homo sapiens
acaaaagcaacugagguucuug

SEQ ID NO: 3841 - RNA, 22 nt, Homo sapiens
ggccaaaaccacaauuacuuuu

SEQ ID NO: 3842 - RNA, 22 nt, Homo sapiens
gcaaaaguaauugagauuuuug

SEQ ID NO: 3843 - RNA, 22 nt, Homo sapiens
ggcaaaaaccgcaauuacuuuu

SEQ ID NO: 3844 - RNA, 22 nt, Homo sapiens
gcaaaagaaacugugguuuuug

SEQ ID NO: 3845 - RNA, 22 nt, Homo sapiens
ggcaaaaaccacaauuacuuuu

SEQ ID NO: 3846 - RNA, 22 nt, Homo sapiens
ugcaaaaguagucucaguuuuu

SEQ ID NO: 3847 - RNA, 19 nt, Homo sapiens
aaaaguaauuacaguuuuu

SEQ ID NO: 3848 - RNA, 22 nt, Homo sapiens
guacaaaaguaauuacaguuuu

SEQ ID NO: 3849 - RNA, 23 nt, Homo sapiens
caaaaacugcaauuacuuuugca

SEQ ID NO: 3850 - RNA, 23 nt, Homo sapiens
ugcaaaaguaauugcgguuuuug

SEQ ID NO: 3851 - RNA, 22 nt, Homo sapiens
gacaaaaaccgcgauuacuuuu

SEQ ID NO: 3852 - RNA, 22 nt, Homo sapiens
ggcaaaauccgcaauuacuuuu

SEQ ID NO: 3853 - RNA, 22 nt, Homo sapiens
accaaagaccgcaauuacuuuu

SEQ ID NO: 3854 - RNA, 22 nt, Homo sapiens
agcaaaauccgcaaguacuuuu

SEQ ID NO: 3855 - RNA, 22 nt, Homo sapiens
gacaaaacccgcaaauacuuuu

SEQ ID NO: 3856 - RNA, 21 nt, Homo sapiens
caaaaaccacaaauaccuuug

SEQ ID NO: 3857 - RNA, 22 nt, Homo sapiens
acaaaauccacaauuacuuuug

SEQ ID NO: 3858 - RNA, 22 nt, Homo sapiens
gcaaaaguaacugcaguuuugg

SEQ ID NO: 3859 - RNA, 22 nt, Homo sapiens
ggcaaaaaccgcaauuacuuuu

SEQ ID NO: 3860 - RNA, 22 nt, Homo sapiens
aaaguaacugcaguuuuugcua

SEQ ID NO: 3861 - RNA, 22 nt, Homo sapiens
ccgccauuacuuuugcaccagc

SEQ ID NO: 3862 - RNA, 23 nt, Homo sapiens
aaaauaacugcaguuuuggccau

SEQ ID NO: 3863 - RNA, 25 nt, Homo sapiens
uggugcaaaaguaauugugguuuuu

SEQ ID NO: 3864 - RNA, 21 nt, Homo sapiens
caaaaaccacgaucacuuuug

SEQ ID NO: 3865 - RNA, 23 nt, Homo sapiens
cgcaaaaguaauugcagucuuug

SEQ ID NO: 3866 - RNA, 23 nt, Homo sapiens
aggcaaaaaccgcaguuacuuuu

SEQ ID NO: 3867 - RNA, 22 nt, Homo sapiens
ggcaaaaacagugauuacuuuu

SEQ ID NO: 3868 - RNA, 23 nt, Homo sapiens
ugcaaaaguaauugcgguuuuug

SEQ ID NO: 3869 - RNA, 21 nt, Homo sapiens
agagcucauccauaguuguca

SEQ ID NO: 3870 - RNA, 20 nt, Homo sapiens
cucuuacucccucaggcacu

SEQ ID NO: 3871 - RNA, 22 nt, Homo sapiens
augugccugagggaguaagaca

SEQ ID NO: 3872 - RNA, 23 nt, Homo sapiens
gggcucuuacucccucaggcacu

SEQ ID NO: 3873 - RNA, 22 nt, Homo sapiens
ugucuuacucccucaggcacau

SEQ ID NO: 3874 - RNA, 20 nt, Homo sapiens
cagugccugagggaguaaga

SEQ ID NO: 3875 - RNA, 21 nt, Homo sapiens
uggaaaccaagagugggucgc

SEQ ID NO: 3876 - RNA, 21 nt, Homo sapiens
cugaaaccaaguaugggucgc

SEQ ID NO: 3877 - RNA, 22 nt, Homo sapiens
ggucucacccacgcuugauuuc

SEQ ID NO: 3878 - RNA, 21 nt, Homo sapiens
uugucuaaccagucaccuguu

SEQ ID NO: 3879 - RNA, 21 nt, Homo sapiens
aaaacaaaaucucaccguuuu

SEQ ID NO: 3880 - RNA, 21 nt, Homo sapiens
acuggcugagucaggacuagc

SEQ ID NO: 3881 - RNA, 21 nt, Homo sapiens
aucagagguucagcuuacccu

SEQ ID NO: 3882 - RNA, 22 nt, Homo sapiens
aaagaugagcuaaugguaauau

SEQ ID NO: 3883 - RNA, 22 nt, Homo sapiens
cucauauuacaaugagcucauc

SEQ ID NO: 3884 - RNA, 23 nt, Homo sapiens
agacaaggcccacccgugcaaac

SEQ ID NO: 3885 - RNA, 19 nt, Homo sapiens
cagaggagccuccuaggac

SEQ ID NO: 3886 - RNA, 21 nt, Homo sapiens
gggaggcuccuuugagaauug

SEQ ID NO: 3887 - RNA, 21 nt, Homo sapiens
agcagaccccugcaccccaac

SEQ ID NO: 3888 - RNA, 22 nt, Homo sapiens
gaucugguacuccuuaagcuaa

SEQ ID NO: 3889 - RNA, 21 nt, Homo sapiens
guuagcuuaaggaguaccaua

SEQ ID NO: 3890 - RNA, 19 nt, Homo sapiens
auuuugguacagcagcuca

SEQ ID NO: 3891 - RNA, 22 nt, Homo sapiens
gugcuggcucacuucauaugug

SEQ ID NO: 3892 - RNA, 22 nt, Homo sapiens
acacauaugaaaugagccagca

SEQ ID NO: 3893 - RNA, 22 nt, Homo sapiens
ggaacuucuaggaggcauggaa

SEQ ID NO: 3894 - RNA, 22 nt, Homo sapiens
ucuccauuucuccuggaaggcu

SEQ ID NO: 3895 - RNA, 22 nt, Homo sapiens
ccuaggcacacuuaaaguuuua

SEQ ID NO: 3896 - RNA, 22 nt, Homo sapiens
gcuauaacuuuaagugugccua

SEQ ID NO: 3897 - RNA, 22 nt, Homo sapiens
ccaaacuaauauacccauauuc

SEQ ID NO: 3898 - RNA, 22 nt, Homo sapiens
cagaauauggguauauuaguuu

SEQ ID NO: 3899 - RNA, 22 nt, Homo sapiens
aauugggcaaagggaagaacua

SEQ ID NO: 3900 - RNA, 22 nt, Homo sapiens
ucuaguucuucccauuucccug

SEQ ID NO: 3901 - RNA, 22 nt, Homo sapiens
accuguagucccagcuauucag

SEQ ID NO: 3902 - RNA, 22 nt, Homo sapiens
cucucgaguagcugguacuuca

SEQ ID NO: 3903 - RNA, 22 nt, Homo sapiens
cuuuaaccagcuugucacucug

SEQ ID NO: 3904 - RNA, 22 nt, Homo sapiens
gcauauaguaacaagcuggaua

SEQ ID NO: 3905 - RNA, 21 nt, Homo sapiens
gaugaucacacugcccggggc

SEQ ID NO: 3906 - RNA, 18 nt, Homo sapiens
agucccggaggugaccau

SEQ ID NO: 3907 - RNA, 19 nt, Homo sapiens
gcuggcauuagugggacuu

SEQ ID NO: 3908 - RNA, 21 nt, Homo sapiens
aaaagucccacuaaugccagu

SEQ ID NO: 3909 - RNA, 23 nt, Homo sapiens
ugggagcuagguugccaugugca

SEQ ID NO: 3910 - RNA, 21 nt, Homo sapiens
acugcacaagagcacccagcc

SEQ ID NO: 3911 - RNA, 21 nt, Homo sapiens
uuuuggugcauauuuacuuua

SEQ ID NO: 3912 - RNA, 21 nt, Homo sapiens
uugccauacaugaacuuuauu

SEQ ID NO: 3913 - RNA, 21 nt, Homo sapiens
aauaaagucuauguauggcaa

SEQ ID NO: 3914 - RNA, 21 nt, Homo sapiens
ugggagcuaagcuauggguau

SEQ ID NO: 3915 - RNA, 21 nt, Homo sapiens
auacccauagcuuagcuccca

SEQ ID NO: 3916 - RNA, 22 nt, Homo sapiens
acuucaaggaucuuaaacuuug

SEQ ID NO: 3917 - RNA, 22 nt, Homo sapiens
ggcaaaguuuaagauccuugau

SEQ ID NO: 3918 - RNA, 20 nt, Homo sapiens
gcaaaugguacagcuacuuu

SEQ ID NO: 3919 - RNA, 19 nt, Homo sapiens
gggaaacguaugucaaccu

SEQ ID NO: 3920 - RNA, 19 nt, Homo sapiens
gccugcugacaccgugccu

SEQ ID NO: 3921 - RNA, 19 nt, Homo sapiens
guugggaucacaggcgccc

SEQ ID NO: 3922 - RNA, 23 nt, Homo sapiens
guucuguccuggaagaacauacu

SEQ ID NO: 3923 - RNA, 20 nt, Homo sapiens
guguguauacauuuauacau

SEQ ID NO: 3924 - RNA, 22 nt, Homo sapiens
gcagauuaguccagcauuucuc

SEQ ID NO: 3925 - RNA, 22 nt, Homo sapiens
aagagguauugccacccuuucu

SEQ ID NO: 3926 - RNA, 22 nt, Homo sapiens
acuagaaaggguggcaauaccu

SEQ ID NO: 3927 - RNA, 22 nt, Homo sapiens
accuuauccugcaaggugcuac

SEQ ID NO: 3928 - RNA, 24 nt, Homo sapiens
gaagucagagaaucugcaucugua

SEQ ID NO: 3929 - RNA, 20 nt, Homo sapiens
cuguugcucaggcuagaguu

SEQ ID NO: 3930 - RNA, 22 nt, Homo sapiens
cccgugauaacugcugggcugu

SEQ ID NO: 3931 - RNA, 21 nt, Homo sapiens
acaauacaauacgauacgaua

SEQ ID NO: 3932 - RNA, 22 nt, Homo sapiens
auuugacccuaaaacguucuaa

SEQ ID NO: 3933 - RNA, 22 nt, Homo sapiens
gcuguuuuacagguguuuguua

SEQ ID NO: 3934 - RNA, 22 nt, Homo sapiens
ucuaggacuacagguguaugcu

SEQ ID NO: 3935 - RNA, 21 nt, Homo sapiens
acuuuccaggauucauuaacu

SEQ ID NO: 3936 - RNA, 21 nt, Homo sapiens
ccuaauagagguaguagcuga

SEQ ID NO: 3937 - RNA, 22 nt, Homo sapiens
gcuuucucggagcucagagcaa

SEQ ID NO: 3938 - RNA, 22 nt, Homo sapiens
acacccacugugguauuauuug

SEQ ID NO: 3939 - RNA, 20 nt, Homo sapiens
acaccuacugugauauuauu

SEQ ID NO: 3940 - RNA, 22 nt, Homo sapiens
guacaccuacugugauauuauu

SEQ ID NO: 3941 - RNA, 22 nt, Homo sapiens
gaguucauuucagagccacugc

SEQ ID NO: 3942 - RNA, 21 nt, Homo sapiens
cugagacagucccaugaucug

SEQ ID NO: 3943 - RNA, 22 nt, Homo sapiens
cugucuagauucuucuuggagu

SEQ ID NO: 3944 - RNA, 22 nt, Homo sapiens
ggcaucagacuacuuaaaugag

SEQ ID NO: 3945 - RNA, 22 nt, Homo sapiens
ccuuuaucaugaaacuacuuga

SEQ ID NO: 3946 - RNA, 22 nt, Homo sapiens
ccacaaucacugcacuccccca

SEQ ID NO: 3947 - RNA, 22 nt, Homo sapiens
gcuccaacaaggaaagacagga

SEQ ID NO: 3948 - RNA, 22 nt, Homo sapiens
ccuucaauaauuuaaugcauua

SEQ ID NO: 3949 - RNA, 19 nt, Homo sapiens
aaucagaacgugacaauaa

SEQ ID NO: 3950 - RNA, 22 nt, Homo sapiens
caugggauauguugcugacuca

SEQ ID NO: 3951 - RNA, 18 nt, Homo sapiens
accuucccgacuucuccu

SEQ ID NO: 3952 - RNA, 22 nt, Homo sapiens
gcaaagguaauugcuguuuucg

SEQ ID NO: 3953 - RNA, 22 nt, Homo sapiens
gcauaaugggaugauggccuaa

SEQ ID NO: 3954 - RNA, 23 nt, Homo sapiens
cacaggccaugagccccgaaaca

SEQ ID NO: 3955 - RNA, 22 nt, Homo sapiens
gggaaaaacugcaauuaccuuu

SEQ ID NO: 3956 - RNA, 22 nt, Homo sapiens
agcuucagcauguuauccagaa

SEQ ID NO: 3957 - RNA, 22 nt, Homo sapiens
gccuuguacagcauucaaacgu

SEQ ID NO: 3958 - RNA, 20 nt, Homo sapiens
ggucaggcacagucgcucau

SEQ ID NO: 3959 - RNA, 21 nt, Homo sapiens
cucacucagauggccaacuca

SEQ ID NO: 3960 - RNA, 20 nt, Homo sapiens
ugggccaccgccgagcggac

SEQ ID NO: 3961 - RNA, 24 nt, Homo sapiens
cugaucaguuacacaucacuucag

SEQ ID NO: 3962 - RNA, 20 nt, Homo sapiens
gcuccccauucucucuccgc

SEQ ID NO: 3963 - RNA, 22 nt, Homo sapiens
ugugggugugugcaugagcgug

SEQ ID NO: 3964 - RNA, 23 nt, Homo sapiens
acacacucacacacacacacuca

SEQ ID NO: 3965 - RNA, 19 nt, Homo sapiens
gcuccuguccaacuggcuc

SEQ ID NO: 3966 - RNA, 22 nt, Homo sapiens
gauuccaauuuuuccacaucuu

SEQ ID NO: 3967 - RNA, 22 nt, Homo sapiens
aaagacguggagaaauuagaau

SEQ ID NO: 3968 - RNA, 21 nt, Homo sapiens
cagguaccaauauuuuaucua

SEQ ID NO: 3969 - RNA, 21 nt, Homo sapiens
acaauccuagagcacaagaag

SEQ ID NO: 3970 - RNA, 20 nt, Homo sapiens
accuccccgcgccccagccc

SEQ ID NO: 3971 - RNA, 23 nt, Homo sapiens
aaucgcgguuuauaccaaaugaa

SEQ ID NO: 3972 - RNA, 22 nt, Homo sapiens
ccuaaugauucaucauucucaa

SEQ ID NO: 3973 - RNA, 21 nt, Homo sapiens
acugaucuagagaacacaaga

SEQ ID NO: 3974 - RNA, 22 nt, Homo sapiens
gguucaguuguucaaccaguua

SEQ ID NO: 3975 - RNA, 23 nt, Homo sapiens
aguaacugguugaacaacuguaa

SEQ ID NO: 3976 - RNA, 21 nt, Homo sapiens
guaaugggaccuuccucuuug

SEQ ID NO: 3977 - RNA, 22 nt, Homo sapiens
agccugguuggccuggaacuga

SEQ ID NO: 3978 - RNA, 22 nt, Homo sapiens
cucagucccaggcaaaccauaa

SEQ ID NO: 3979 - RNA, 19 nt, Homo sapiens
uagcauacagauacgccca

SEQ ID NO: 3980 - RNA, 22 nt, Homo sapiens
ggaccuaaaaauacaaugcaua

SEQ ID NO: 3981 - RNA, 21 nt, Homo sapiens
gugacucaucaccuauggaaa

SEQ ID NO: 3982 - RNA, 21 nt, Homo sapiens
guucuaacccauuguggccaa

SEQ ID NO: 3983 - RNA, 24 nt, Homo sapiens
ucugggaaccggcauuuguucuga

SEQ ID NO: 3984 - RNA, 22 nt, Homo sapiens
cucagagcagacgugguucuca

SEQ ID NO: 3985 - RNA, 21 nt, Homo sapiens
acuagcuuauacauaaaauua

SEQ ID NO: 3986 - RNA, 22 nt, Homo sapiens
cugcacuuuuaugaauaagcuc

SEQ ID NO: 3987 - RNA, 20 nt, Homo sapiens
acaaugagaacccauggucu

SEQ ID NO: 3988 - RNA, 22 nt, Homo sapiens
acaucaucgcauauugacacaa

SEQ ID NO: 3989 - RNA, 19 nt, Homo sapiens
agaaaccccagcagagaca

SEQ ID NO: 3990 - RNA, 25 nt, Homo sapiens
gcugagcaaugccuggcuggugccu

SEQ ID NO: 3991 - RNA, 21 nt, Homo sapiens
agacacaccacggcacacuuc

SEQ ID NO: 3992 - RNA, 21 nt, Homo sapiens
cccgaggagccgggcaggcuu

SEQ ID NO: 3993 - RNA, 22 nt, Homo sapiens
acaguggucaucgagugacaca

SEQ ID NO: 3994 - RNA, 22 nt, Homo sapiens
ugacgaugacaacgaugacgua

SEQ ID NO: 3995 - RNA, 20 nt, Homo sapiens
guuugauaaacugacacaac

SEQ ID NO: 3996 - RNA, 23 nt, Homo sapiens
gagcaaggcucuugucuguaagu

SEQ ID NO: 3997 - RNA, 22 nt, Homo sapiens
cuccuccaacaauccuagacca

SEQ ID NO: 3998 - RNA, 23 nt, Homo sapiens
gggccgcagcugucgcccguguc

SEQ ID NO: 3999 - RNA, 22 nt, Homo sapiens
gcaaaaguaauugcagugugug

SEQ ID NO: 4000 - RNA, 19 nt, Homo sapiens
guccugaauuccgcagccu

SEQ ID NO: 4001 - RNA, 23 nt, Homo sapiens
aggagaaggcaccaugggauuua

SEQ ID NO: 4002 - RNA, 21 nt, Homo sapiens
aucuuugauuuucaguaguuu

SEQ ID NO: 4003 - RNA, 21 nt, Homo sapiens
ccaccgccggagacucgcagg

SEQ ID NO: 4004 - RNA, 21 nt, Homo sapiens
gggggcagcaggcccuagccc

SEQ ID NO: 4005 - RNA, 21 nt, Homo sapiens
guuauagaucuggauuugaac

SEQ ID NO: 4006 - RNA, 19 nt, Homo sapiens
cuccagggacuggaaccgg

SEQ ID NO: 4007 - RNA, 19 nt, Homo sapiens
gccuuggccggcagcagaa

SEQ ID NO: 4008 - RNA, 22 nt, Homo sapiens
cuaaggugcagugugaugagga

SEQ ID NO: 4009 - RNA, 20 nt, Homo sapiens
guagcugauaacucacuacc

SEQ ID NO: 4010 - RNA, 20 nt, Homo sapiens
ccaccuagccucugaauauc

SEQ ID NO: 4011 - RNA, 21 nt, Homo sapiens
caccaaugccgccugggccgu

SEQ ID NO: 4012 - RNA, 21 nt, Homo sapiens
ccaccucuccucugucaugcu

SEQ ID NO: 4013 - RNA, 21 nt, Homo sapiens
gaaggccguacagcucuuccc

SEQ ID NO: 4014 - RNA, 19 nt, Homo sapiens
ccacagcuagcucaggcgg

SEQ ID NO: 4015 - RNA, 24 nt, Homo sapiens
cagcuaguugguccaagcuuccaa

SEQ ID NO: 4016 - RNA, 25 nt, Homo sapiens
acggagcugucccaacaccaccccu

SEQ ID NO: 4017 - RNA, 19 nt, Homo sapiens
cgggaacgcccgcacuaga

SEQ ID NO: 4018 - RNA, 24 nt, Homo sapiens
ggcgccuuggccggcacugcuccu

SEQ ID NO: 4019 - RNA, 19 nt, Homo sapiens
ggaucaaccagacguauuc

SEQ ID NO: 4020 - RNA, 20 nt, Homo sapiens
cccacagccucugauauaag

SEQ ID NO: 4021 - RNA, 20 nt, Homo sapiens
ccggccaccgacuggcggaa

SEQ ID NO: 4022 - RNA, 19 nt, Homo sapiens
ugugcucccccagccccuu

SEQ ID NO: 4023 - RNA, 20 nt, Homo sapiens
cucugcccuucccaaccucc

SEQ ID NO: 4024 - RNA, 18 nt, Homo sapiens
gcucgcccccccgccuca

SEQ ID NO: 4025 - RNA, 20 nt, Homo sapiens
cgcccccccgcuucaucucu

SEQ ID NO: 4026 - RNA, 24 nt, Homo sapiens
ccgccccgccccaccccggccucc

SEQ ID NO: 4027 - RNA, 20 nt, Homo sapiens
agagaugagagaaacacccu

SEQ ID NO: 4028 - RNA, 19 nt, Homo sapiens
gccccgccccucgcucccc

SEQ ID NO: 4029 - RNA, 21 nt, Homo sapiens
ucccagcacacauuuagcuca

SEQ ID NO: 4030 - RNA, 23 nt, Homo sapiens
gucagaccccgagggguccucgc

SEQ ID NO: 4031 - RNA, 25 nt, Homo sapiens
aaggagcucagaagcccugcccagc

SEQ ID NO: 4032 - RNA, 20 nt, Homo sapiens
uccucccccuuccuuuuccc

SEQ ID NO: 4033 - RNA, 20 nt, Homo sapiens
uccgccgcuccgccuuccgc

SEQ ID NO: 4034 - RNA, 18 nt, Homo sapiens
ucuccgccgggccuucac

SEQ ID NO: 4035 - RNA, 19 nt, Homo sapiens
ccucccacccacucccuca

SEQ ID NO: 4036 - RNA, 19 nt, Homo sapiens
uuuugacuccaauuccagu

SEQ ID NO: 4037 - RNA, 19 nt, Homo sapiens
uauacacccaacucccuca

SEQ ID NO: 4038 - RNA, 20 nt, Homo sapiens
ggcaaagaaggaacauuccu

SEQ ID NO: 4039 - RNA, 19 nt, Homo sapiens
cauacaauccacucccuca

SEQ ID NO: 4040 - RNA, 19 nt, Homo sapiens
cacucccaucugaccagcc

SEQ ID NO: 4041 - RNA, 19 nt, Homo sapiens
ugcaauccccagcccugcu

SEQ ID NO: 4042 - RNA, 19 nt, Homo sapiens
uacccaaccuccucccuca

SEQ ID NO: 4043 - RNA, 19 nt, Homo sapiens
ucuacauccuaccaccuca

SEQ ID NO: 4044 - RNA, 23 nt, Homo sapiens
ccaccuggcaagaacaggcguuc

SEQ ID NO: 4045 - RNA, 22 nt, Homo sapiens
aagagggagacccaggcucgga

SEQ ID NO: 4046 - RNA, 22 nt, Homo sapiens
gauccgagcaccggggaccccc

SEQ ID NO: 4047 - RNA, 22 nt, Homo sapiens
cugcucaaacccuccaaugacu

SEQ ID NO: 4048 - RNA, 19 nt, Homo sapiens
cuccccucaccuccugcug

SEQ ID NO: 4049 - RNA, 22 nt, Homo sapiens
aagucacugaaggguuuugagu

SEQ ID NO: 4050 - RNA, 22 nt, Homo sapiens
gccaccuucaaaugggaagucu

SEQ ID NO: 4051 - RNA, 23 nt, Homo sapiens
acucagaaggacaaguagaguuu

SEQ ID NO: 4052 - RNA, 24 nt, Homo sapiens
acugggcacaaacauguccagguc

SEQ ID NO: 4053 - RNA, 20 nt, Homo sapiens
auuucuauaucuaucuccau

SEQ ID NO: 4054 - RNA, 21 nt, Homo sapiens
agguaagcgcuguugcuagcc

SEQ ID NO: 4055 - RNA, 21 nt, Homo sapiens
gcuccaaccucagcagacugu

SEQ ID NO: 4056 - RNA, 23 nt, Homo sapiens
acccaacagccccugcaagggau

SEQ ID NO: 4057 - RNA, 21 nt, Homo sapiens
agguaauaccaauaccuugug

SEQ ID NO: 4058 - RNA, 22 nt, Homo sapiens
ugaacacaagguacugguacua

SEQ ID NO: 4059 - RNA, 22 nt, Homo sapiens
ugagggggaaaguucuauaguc

SEQ ID NO: 4060 - RNA, 21 nt, Homo sapiens
ggacuauagaacuuucccccu

SEQ ID NO: 4061 - RNA, 19 nt, Homo sapiens
aagacauuuucagacagcu

SEQ ID NO: 4062 - RNA, 22 nt, Homo sapiens
uccucuuuucuuagagacucac

SEQ ID NO: 4063 - RNA, 21 nt, Homo sapiens
ucgacugccacucuuacuaga

SEQ ID NO: 4064 - RNA, 22 nt, Homo sapiens
ccucuaguaaauaugucagcau

SEQ ID NO: 4065 - RNA, 22 nt, Homo sapiens
gcugggcuuacguugggagaac

SEQ ID NO: 4066 - RNA, 21 nt, Homo sapiens
aguucucccaacguaaaccca

SEQ ID NO: 4067 - RNA, 22 nt, Homo sapiens
accuucccugguacagaauacu

SEQ ID NO: 4068 - RNA, 21 nt, Homo sapiens
gcugaggucugggccaggucu

SEQ ID NO: 4069 - RNA, 19 nt, Homo sapiens
ucccacaggaagcagacac

SEQ ID NO: 4070 - RNA, 23 nt, Homo sapiens
uuuauugugguagauacuauuag

SEQ ID NO: 4071 - RNA, 22 nt, Homo sapiens
guccaaaguuggggugcugguu

SEQ ID NO: 4072 - RNA, 23 nt, Homo sapiens
ggacauuguuucagugcccaagu

SEQ ID NO: 4073 - RNA, 23 nt, Homo sapiens
ugcgggcgggacgagcaagcaca

SEQ ID NO: 4074 - RNA, 24 nt, Homo sapiens
acgcagagcccgaaagcccccagu

SEQ ID NO: 4075 - RNA, 25 nt, Homo sapiens
aggccgccacccgcccgcgaucccu

SEQ ID NO: 4076 - RNA, 23 nt, Homo sapiens
acagcgcucgcaaccgcagcgau

SEQ ID NO: 4077 - RNA, 21 nt, Homo sapiens
agaggcagguuccuggaucau

SEQ ID NO: 4078 - RNA, 24 nt, Homo sapiens
gaggugacucuauccuaugucuuu

SEQ ID NO: 4079 - RNA, 22 nt, Homo sapiens
gguucccucuccaaaugugucu

SEQ ID NO: 4080 - RNA, 22 nt, Homo sapiens
caagacacauuuggagagggac

SEQ ID NO: 4081 - RNA, 22 nt, Homo sapiens
gggucccucuccaaaugugucu

SEQ ID NO: 4082 - RNA, 22 nt, Homo sapiens
agacacauuuggagagggaacc

SEQ ID NO: 4083 - RNA, 22 nt, Homo sapiens
cuaccugagcuagcauacaagu

SEQ ID NO: 4084 - RNA, 19 nt, Homo sapiens
gcucuaagaaagccacacu

SEQ ID NO: 4085 - RNA, 19 nt, Homo sapiens
ucagcaguaccagccuaga

SEQ ID NO: 4086 - RNA, 19 nt, Homo sapiens
gccucagaggcagcugcuu

SEQ ID NO: 4087 - RNA, 21 nt, Homo sapiens
gaaggaagugagugcagccac

SEQ ID NO: 4088 - RNA, 19 nt, Homo sapiens
accagugcccugcacacuu

SEQ ID NO: 4089 - RNA, 22 nt, Homo sapiens
gacucuugaacaacacagguuu

SEQ ID NO: 4090 - RNA, 22 nt, Homo sapiens
ugugggcaaaacaaacacugcu

SEQ ID NO: 4091 - RNA, 22 nt, Homo sapiens
acugcagugcucuugcgcccga

SEQ ID NO: 4092 - RNA, 21 nt, Homo sapiens
guccugagagcgcugccuccu

SEQ ID NO: 4093 - RNA, 21 nt, Homo sapiens
gcaggucaucccaacaagugu

SEQ ID NO: 4094 - RNA, 24 nt, Homo sapiens
ggacaccuggaguggauagcuccu

SEQ ID NO: 4095 - RNA, 23 nt, Homo sapiens
acuguuaccgcaggcugcucugg

SEQ ID NO: 4096 - RNA, 22 nt, Homo sapiens
accaaaggcagcccuggcaacu

SEQ ID NO: 4097 - RNA, 21 nt, Homo sapiens
auacucuagaaagauggucua

SEQ ID NO: 4098 - RNA, 22 nt, Homo sapiens
ggucaacaaucuuucuagagcu

SEQ ID NO: 4099 - RNA, 21 nt, Homo sapiens
ggaggucugcauccuaguccc

SEQ ID NO: 4100 - RNA, 23 nt, Homo sapiens
ucuggggauuugaaugcagaccu

SEQ ID NO: 4101 - RNA, 20 nt, Homo sapiens
agaauggcugugcuguaaug

SEQ ID NO: 4102 - RNA, 21 nt, Homo sapiens
cugcauuacagcacagccaga

SEQ ID NO: 4103 - RNA, 21 nt, Homo sapiens
cuuuggaagagguagaaguca

SEQ ID NO: 4104 - RNA, 22 nt, Homo sapiens
gcugagauauccccuauuccaa

SEQ ID NO: 4105 - RNA, 22 nt, Homo sapiens
gugucuggaaucucugauacga

SEQ ID NO: 4106 - RNA, 23 nt, Homo sapiens
accauauucagugacaucccagu

SEQ ID NO: 4107 - RNA, 22 nt, Homo sapiens
gggaaaaauaggaaggacuuug

SEQ ID NO: 4108 - RNA, 21 nt, Homo sapiens
acaaagucccuccuauucuuc

SEQ ID NO: 4109 - RNA, 22 nt, Homo sapiens
aguucuagaaaugcauggccca

SEQ ID NO: 4110 - RNA, 21 nt, Homo sapiens
ggugggucaugcauuucuaga

SEQ ID NO: 4111 - RNA, 22 nt, Homo sapiens
aaauuagguaguggcaguggaa

SEQ ID NO: 4112 - RNA, 21 nt, Homo sapiens
guuccacugccacuaccuaau

SEQ ID NO: 4113 - RNA, 22 nt, Homo sapiens
caaaagucaagcuuauccuaaa

SEQ ID NO: 4114 - RNA, 21 nt, Homo sapiens
cugcaggagacagagucggug

SEQ ID NO: 4115 - RNA, 22 nt, Homo sapiens
gacuccucucucuccccugcug

SEQ ID NO: 4116 - RNA, 22 nt, Homo sapiens
gcaggcagaagggauggugagg

SEQ ID NO: 4117 - RNA, 23 nt, Homo sapiens
ccugucagccccacuucugccug

SEQ ID NO: 4118 - RNA, 23 nt, Homo sapiens
ugcaggcagaagggguggugagg

SEQ ID NO: 4119 - RNA, 24 nt, Homo sapiens
ugucagccccacuucugccugcag

SEQ ID NO: 4120 - RNA, 22 nt, Homo sapiens
ccuaccauuagaagggcuggaa

SEQ ID NO: 4121 - RNA, 22 nt, Homo sapiens
ucuuccagcucuucuaauggua

SEQ ID NO: 4122 - RNA, 21 nt, Homo sapiens
cuagggacagaugacacuuga

SEQ ID NO: 4123 - RNA, 23 nt, Homo sapiens
agacauguggcgucaaucccaaa

SEQ ID NO: 4124 - RNA, 21 nt, Homo sapiens
cuggaguggaagaacaggcag

SEQ ID NO: 4125 - RNA, 23 nt, Homo sapiens
gccagcugaaaguccacuccaua

SEQ ID NO: 4126 - RNA, 20 nt, Homo sapiens
cugggggguagaugaagaga

SEQ ID NO: 4127 - RNA, 21 nt, Homo sapiens
gaugucuuccacacccuccaa

SEQ ID NO: 4128 - RNA, 21 nt, Homo sapiens
cacaacccuaguggcgccauu

SEQ ID NO: 4129 - RNA, 25 nt, Homo sapiens
ugaauggcacccucuccuaggguug

SEQ ID NO: 4130 - RNA, 21 nt, Homo sapiens
caguagagauuguuucaacac

SEQ ID NO: 4131 - RNA, 22 nt, Homo sapiens
aaggugauggucagcagacaua

SEQ ID NO: 4132 - RNA, 22 nt, Homo sapiens
gcacauguucugcggcccacca

SEQ ID NO: 4133 - RNA, 22 nt, Homo sapiens
aaagagguuaaccauguauuau

SEQ ID NO: 4134 - RNA, 21 nt, Homo sapiens
agagguugacuguauaauauu

SEQ ID NO: 4135 - RNA, 23 nt, Homo sapiens
ccuagagagggugagaaccugcc

SEQ ID NO: 4136 - RNA, 25 nt, Homo sapiens
accaacggaccuacuucccuccgcc

SEQ ID NO: 4137 - RNA, 22 nt, Homo sapiens
uggggacccucccugaaccaag

SEQ ID NO: 4138 - RNA, 22 nt, Homo sapiens
uccuugguucagggaagguccu

SEQ ID NO: 4139 - RNA, 21 nt, Homo sapiens
uaauccaugcacacaggaggu

SEQ ID NO: 4140 - RNA, 22 nt, Homo sapiens
caacuccgauaugcaaugggua

SEQ ID NO: 4141 - RNA, 24 nt, Homo sapiens
acgcgcaggccagagacccaggca

SEQ ID NO: 4142 - RNA, 21 nt, Homo sapiens
cugcugggccacaacguggga

SEQ ID NO: 4143 - RNA, 22 nt, Homo sapiens
gcggucccgcggcgccccgccu

SEQ ID NO: 4144 - RNA, 22 nt, Homo sapiens
ccucaggcacggccgggccacc

SEQ ID NO: 4145 - RNA, 23 nt, Homo sapiens
uguaggcuggggauaaaugaaua

SEQ ID NO: 4146 - RNA, 24 nt, Homo sapiens
auccaaucauuuucccuagccagu

SEQ ID NO: 4147 - RNA, 22 nt, Homo sapiens
uguaggcugggaggcaaaugaa

SEQ ID NO: 4148 - RNA, 24 nt, Homo sapiens
uacccaaucaucucccuuagccca

SEQ ID NO: 4149 - RNA, 20 nt, Homo sapiens
aggggccucagccuccuggu

SEQ ID NO: 4150 - RNA, 23 nt, Homo sapiens
guagugggccgagccgagugaca

SEQ ID NO: 4151 - RNA, 20 nt, Homo sapiens
caccacauacacucagggac

SEQ ID NO: 4152 - RNA, 21 nt, Homo sapiens
gguggagcccugagaaccgga

SEQ ID NO: 4153 - RNA, 21 nt, Homo sapiens
ccacaggcacgacugguuugg

SEQ ID NO: 4154 - RNA, 22 nt, Homo sapiens
ccacaggcacagccgguuugag

SEQ ID NO: 4155 - RNA, 21 nt, Homo sapiens
ugccaaaccagucgugccugu

SEQ ID NO: 4156 - RNA, 23 nt, Homo sapiens
cuccagccccuccagggcuuccu

SEQ ID NO: 4157 - RNA, 22 nt, Homo sapiens
gcagaggaauggagaguucgga

SEQ ID NO: 4158 - RNA, 20 nt, Homo sapiens
ggcccuuacccccauuccca

SEQ ID NO: 4159 - RNA, 22 nt, Homo sapiens
ucucuacauccccacaucgccu

SEQ ID NO: 4160 - RNA, 21 nt, Homo sapiens
ucauaagcccucugaccacua

SEQ ID NO: 4161 - RNA, 22 nt, Homo sapiens
caggagaaucacugaugucaga

SEQ ID NO: 4162 - RNA, 22 nt, Homo sapiens
ucuaccaguuccugcaggcgcg

SEQ ID NO: 4163 - RNA, 23 nt, Homo sapiens
cuccuacaauaagccccugccca

SEQ ID NO: 4164 - RNA, 22 nt, Homo sapiens
ccuggcccacccgaccccugca

SEQ ID NO: 4165 - RNA, 20 nt, Homo sapiens
gcauguggucgggugcgccu

SEQ ID NO: 4166 - RNA, 22 nt, Homo sapiens
gccccgacguuacucggacuau

SEQ ID NO: 4167 - RNA, 23 nt, Homo sapiens
ccccacgcccgccgcgggcccag

SEQ ID NO: 4168 - RNA, 20 nt, Homo sapiens
ugagcggugagggcauacag

SEQ ID NO: 4169 - RNA, 23 nt, Homo sapiens
cacugugggcccucuccgcacca

SEQ ID NO: 4170 - RNA, 21 nt, Homo sapiens
aacucaacaaccuuaggacag

SEQ ID NO: 4171 - RNA, 21 nt, Homo sapiens
ugcaaguccugagguugaaga

SEQ ID NO: 4172 - RNA, 22 nt, Homo sapiens
cuagaagcucacagucuaguug

SEQ ID NO: 4173 - RNA, 23 nt, Homo sapiens
cccagcuagauuguaagcuccuu

SEQ ID NO: 4174 - RNA, 22 nt, Homo sapiens
cuuacgucucucccuggguccc

SEQ ID NO: 4175 - RNA, 22 nt, Homo sapiens
uauggcagacugugauuuguug

SEQ ID NO: 4176 - RNA, 21 nt, Homo sapiens
cgacgcccggcggggcggaag

SEQ ID NO: 4177 - RNA, 22 nt, Homo sapiens
uuagguagacugggauuuguug

SEQ ID NO: 4178 - RNA, 22 nt, Homo sapiens
agguugagguuaguggcaacag

SEQ ID NO: 4179 - RNA, 22 nt, Homo sapiens
ugcuguuagcccuagccccgca

SEQ ID NO: 4180 - RNA, 22 nt, Homo sapiens
gguuaguggaccaggucacaaa

SEQ ID NO: 4181 - RNA, 22 nt, Homo sapiens
gugugcucucuggucaaccauc

SEQ ID NO: 4182 - RNA, 22 nt, Homo sapiens
gucaaaauuguuugcacucugc

SEQ ID NO: 4183 - RNA, 23 nt, Homo sapiens
acaacaaaaucacuagucuucca

SEQ ID NO: 4184 - RNA, 20 nt, Homo sapiens
uccccacagacccagagccg

SEQ ID NO: 4185 - RNA, 22 nt, Homo sapiens
ugugucaguuucacccugcugc

SEQ ID NO: 4186 - RNA, 22 nt, Homo sapiens
gcucggccccggccccagcccc

SEQ ID NO: 4187 - RNA, 22 nt, Homo sapiens
aggaggacaagugagcaccugc

SEQ ID NO: 4188 - RNA, 21 nt, Homo sapiens
caucaccuuccuucuccucca

SEQ ID NO: 4189 - RNA, 22 nt, Homo sapiens
gcugaggcuguggggcuggagu

SEQ ID NO: 4190 - RNA, 22 nt, Homo sapiens
aagaccagcaccaauuccuccu

SEQ ID NO: 4191 - RNA, 23 nt, Homo sapiens
agaaaccaugggguaugagcaga

SEQ ID NO: 4192 - RNA, 23 nt, Homo sapiens
caugcucagacaaccauggugca

SEQ ID NO: 4193 - RNA, 23 nt, Homo sapiens
aaccaagaccccggagaucccag

SEQ ID NO: 4194 - RNA, 22 nt, Homo sapiens
agcucagaacccagaggucuca

SEQ ID NO: 4195 - RNA, 23 nt, Homo sapiens
uggcccugacacgugguacugga

SEQ ID NO: 4196 - RNA, 23 nt, Homo sapiens
acaaggaugaaucuuuguuacug

SEQ ID NO: 4197 - RNA, 22 nt, Homo sapiens
ucccgggaacucaucagucucc

SEQ ID NO: 4198 - RNA, 21 nt, Homo sapiens
aggagacucacaaguuccugc

SEQ ID NO: 4199 - RNA, 22 nt, Homo sapiens
ucggucccucgggccagggcag

SEQ ID NO: 4200 - RNA, 21 nt, Homo sapiens
cacaaccucaguguuuccagg

SEQ ID NO: 4201 - RNA, 22 nt, Homo sapiens
caccugauaaaacugagguaua

SEQ ID NO: 4202 - RNA, 22 nt, Homo sapiens
ugaauuacuuuguaaaccacca

SEQ ID NO: 4203 - RNA, 22 nt, Homo sapiens
uggugauucacaaagaaaucca

SEQ ID NO: 4204 - RNA, 21 nt, Homo sapiens
cugggaggagggagaagagga

SEQ ID NO: 4205 - RNA, 20 nt, Homo sapiens
cccugcgccaucuccucuac

SEQ ID NO: 4206 - RNA, 22 nt, Homo sapiens
uauccacuacaccccgcugccu

SEQ ID NO: 4207 - RNA, 22 nt, Homo sapiens
agaggcaggguaguguaaugga

SEQ ID NO: 4208 - RNA, 22 nt, Homo sapiens
ccucgggauggcgcccguucac

SEQ ID NO: 4209 - RNA, 22 nt, Homo sapiens
uucacccaaagaggugucaguc

SEQ ID NO: 4210 - RNA, 21 nt, Homo sapiens
ugacugacagcuuuuugagua

SEQ ID NO: 4211 - RNA, 21 nt, Homo sapiens
acaaugguuguccgauauuaa

SEQ ID NO: 4212 - RNA, 21 nt, Homo sapiens
caacugaugccuuuccaagua

SEQ ID NO: 4213 - RNA, 22 nt, Homo sapiens
ucaguggcucagguucguugca

SEQ ID NO: 4214 - RNA, 22 nt, Homo sapiens
ucaaugacucagguaaguugca

SEQ ID NO: 4215 - RNA, 21 nt, Homo sapiens
cuacgcagaaaggacacagug

SEQ ID NO: 4216 - RNA, 22 nt, Homo sapiens
ucuacccagaaaggagccagug

SEQ ID NO: 4217 - RNA, 22 nt, Homo sapiens
uccacucagaaaggaaacagug

SEQ ID NO: 4218 - RNA, 21 nt, Homo sapiens
ugacuggcaccuuucugaaua

SEQ ID NO: 4219 - RNA, 20 nt, Homo sapiens
uacugcuuccacagcucccc

SEQ ID NO: 4220 - RNA, 25 nt, Homo sapiens
gaauccugguucugucccucacuag

SEQ ID NO: 4221 - RNA, 23 nt, Homo sapiens
gacguaguccuauucucugcugc

SEQ ID NO: 4222 - RNA, 20 nt, Homo sapiens
gcaagacaucacaagacucu

SEQ ID NO: 4223 - RNA, 23 nt, Homo sapiens
agcauugcaaccgaucccaaccu

SEQ ID NO: 4224 - RNA, 22 nt, Homo sapiens
guaaugcaacaaauccccaccc

SEQ ID NO: 4225 - RNA, 22 nt, Homo sapiens
acaggccgggacaagugcaaua

SEQ ID NO: 4226 - RNA, 22 nt, Homo sapiens
ggaggccgggacgagugcaaua

SEQ ID NO: 4227 - RNA, 22 nt, Homo sapiens
cacugcaccgcgucccgucccu

SEQ ID NO: 4228 - RNA, 22 nt, Homo sapiens
gggagaggucucccugcgcaca

SEQ ID NO: 4229 - RNA, 22 nt, Homo sapiens
cgggaagugcuagcucagcagu

SEQ ID NO: 4230 - RNA, 22 nt, Homo sapiens
ccagugucuccaguaguagaca

SEQ ID NO: 4231 - RNA, 23 nt, Homo sapiens
gcgguagcggaagcgguaacugg

SEQ ID NO: 4232 - RNA, 23 nt, Homo sapiens
cuaccugcacgaacagcacuuug

SEQ ID NO: 4233 - RNA, 22 nt, Homo sapiens
cugcgauuccucccucuacugu

SEQ ID NO: 4234 - RNA, 22 nt, Homo sapiens
ggcagagagucagagcgcggau

SEQ ID NO: 4235 - RNA, 20 nt, Homo sapiens
ccagccccacccugacucac

SEQ ID NO: 4236 - RNA, 22 nt, Homo sapiens
acuggguucaccuuuaagggca

SEQ ID NO: 4237 - RNA, 21 nt, Homo sapiens
cuggggagcagaggcccaggg

SEQ ID NO: 4238 - RNA, 24 nt, Homo sapiens
cacccccagagccucagcucccca

SEQ ID NO: 4239 - RNA, 22 nt, Homo sapiens
acuuucgguuaucuagcuuuau

SEQ ID NO: 4240 - RNA, 21 nt, Homo sapiens
ggggagcgggggcccugccuu

SEQ ID NO: 4241 - RNA, 23 nt, Homo sapiens
gcacaugugcacacagccgggug

SEQ ID NO: 4242 - RNA, 22 nt, Homo sapiens
cacauggccaaaacagagaaga

SEQ ID NO: 4243 - RNA, 21 nt, Homo sapiens
cuggaggacggcaacagucag

SEQ ID NO: 4244 - RNA, 22 nt, Homo sapiens
cucauccgauguacaauaauuu

SEQ ID NO: 4245 - RNA, 22 nt, Homo sapiens
ugcucaauaaauacccguugaa

SEQ ID NO: 4246 - RNA, 23 nt, Homo sapiens
ucauacagcuagauaaccaaaga

SEQ ID NO: 4247 - RNA, 22 nt, Homo sapiens
cauauuggcacugcacaugauu

SEQ ID NO: 4248 - RNA, 23 nt, Homo sapiens
agcaaaaaugugcuagugccaaa

SEQ ID NO: 4249 - RNA, 22 nt, Homo sapiens
gggaaaguaguaaguuguauag

SEQ ID NO: 4250 - RNA, 22 nt, Homo sapiens
aacaauacaacuuacuaccuca

SEQ ID NO: 4251 - RNA, 22 nt, Homo sapiens
cagacccauagaagcgagcuug

SEQ ID NO: 4252 - RNA, 22 nt, Homo sapiens
cacaagaucggaucuacggguu

SEQ ID NO: 4253 - RNA, 22 nt, Homo sapiens
cggacccacagacacgagcuug

SEQ ID NO: 4254 - RNA, 22 nt, Homo sapiens
cgcaaggucgguucuacgggug

SEQ ID NO: 4255 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 4256 - DNA, 800 bp, Artificial Sequence
  Description of Artificial Sequence: Synthetic Transcript Sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 4257 - DNA, 800 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 4258 - RNA, 758 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 4259 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 4260 - DNA, 27 bp, Homo sapiens
ttggaccctcgtacagaagctaatacg

SEQ ID NO: 4261 - DNA, 149 bp, Homo sapiens
ttttttttttttttttttttttttttttttttttttttttttttttttttttttttttttttttttttttttttttttttttttttttttttttttttttttttttttttttttttttttcttcctactcaggctttattcaaagacca

SEQ ID NO: 4262 - DNA, 29 bp, Homo sapiens
cttcctactcaggctttattcaaagacca

SEQ ID NO: 4263 - DNA, 20 bp, Homo sapiens
tggccggtcccgcgacccaa

SEQ ID NO: 4264 - DNA, 20 bp, Homo sapiens
gcttcacggctgcgcaagat

SEQ ID NO: 4265 - DNA, 803 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgatgataagctgccttctgcggggcttgccttctggccatgcccttcttctctcccttgcacctgtacctcttggtctttgaataaagcctgagtaggaaggcggccgctcgagcatgcatctaga

SEQ ID NO: 4266 - RNA, 758 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuggucuuugaauaaagccugaguaggaag

SEQ ID NO: 4267 - DNA, 825 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgatgataagctgccttctgcggggcttgccttctggccatgcccttcttctctcccttgcacctgtacctctcaaacaccattgtcacactccatggtctttgaataaagcctgagtaggaaggcggccgctcgagcatgcatctaga

SEQ ID NO: 4268 - RNA, 780 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucucaaacaccauugucacacuccauggucuuugaauaaagccugaguaggaag

SEQ ID NO: 4269 - DNA, 863 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgatgataagctgccttctgcggggcttgccttctggccatgcccttcttctctcccttgcacctgtacctctcaaacaccattgtcacaaacaccattgtcacaaacaccattgtcacaaacaccattgtcatggtctttgaataaagcctgagtaggaaggcggccgctcgagcatgcatctaga

SEQ ID NO: 4270 - RNA, 818 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucucaaacaccauugucacaaacaccauugucacaaacaccauugucacaaacaccauugucauggucuuugaauaaagccugaguaggaag

SEQ ID NO: 4271 - protein, 30 aa, Homo sapiens; identical to SEQ ID NO: 99

SEQ ID NO: 4272 - protein, 25 aa, Homo sapiens
MMPSSVSWGILLLAGLCCLVPVSLA

SEQ ID NO: 4273 - protein, 46 aa, Homo sapiens; identical to SEQ ID NO: 100

SEQ ID NO: 4274 - protein, 21 aa, Homo sapiens
MKGSLLLLLVSNLLLCQSVAP

SEQ ID NO: 4275 - protein, 24 aa, Homo sapiens
MKWVTFISLLFLFSSAYSRGVFRR

SEQ ID NO: 4276 - protein, 9 aa, Homo sapiens
PVAIIELEL

SEQ ID NO: 4277 - protein, 10 aa, Homo sapiens
VNQILKTLSE

SEQ ID NO: 4278 - protein, 7 aa, Homo sapiens
PKKKRKV

SEQ ID NO: 4279 - DNA, 1076 bp, Homo sapiens
gacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggagtgacttcctccactgaagtcttgaatccctccaagtcatccatgaagattggaatcatcatcttccaaactcctgttaatattgatattctggcctcttcccatgaatcatgaatgttcttaaagggatctagaatggcagatcctttccagaaggttttcaatttaatttgcccagatccataagaggaatcactgtctatggcagctatagccttatgaaatgtggtttttgttttgttttgtttttttgagacggagtctcgctctgttgccaggttggagtgcagtggtgtgatctcggctcactgcaacccctgcctccccggttcaagggattctcctgcctcagcctcctgagtagctgggactacaggtgcacaccaccgtgcccagctaatttttgtattttttgt

SEQ ID NO: 4280 - DNA, 1490 bp, Homo sapiens
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 4281 - DNA, 1577 bp, Homo sapiens
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 4282 - DNA, 1397 bp, Homo sapiens
aggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 4283 - DNA, 3025 bp, Homo sapiens
actcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccag

SEQ ID NO: 4284 - DNA, 1543 bp, Homo sapiens
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctga

SEQ ID NO: 4285 - DNA, 2777 bp, Homo sapiens
tcagcagctgccctcactgggcagggcaaattataccgtggcccgaccataaaagccactttccaaaaaaagaagctttaaggcccccgagagacgcagctgagcctctcacctggcagtgcctgactcaggaggtgatgtctgggccatgagccacagagcctggtgtccctttaagcagggagtacaaattctcatccctccctcctgctctccctgacgtcagctggaaggcgtgtgagtgagtgaggggctgaggtaccgcccgcgcgagcacacacagacacacacacacacacacacacacacacacacacacatcttccagacccatcccctgcctgccagctccacgagccagagagagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccac

SEQ ID NO: 4286 - DNA, 1263 bp, Homo sapiens
atgtcggaggagcagttcggcggggacggggcggcggcagcggcaacggcggcggcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 4287 - DNA, 3033 bp, Homo sapiens
aaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagtttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagaga

SEQ ID NO: 4288 - DNA, 1411 bp, Homo sapiens
gtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaat

SEQ ID NO: 4289 - DNA, 607 bp, Homo sapiens
ttaaaggcccccaaggctgtgcaacgcggagcgtgagaggaagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagcc

SEQ ID NO: 4290 - DNA, 748 bp, Homo sapiens
tgtgcaacgcggagcgtgagaggaagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataag

SEQ ID NO: 4291 - DNA, 1585 bp, Homo sapiens
ccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaa

SEQ ID NO: 4292 - DNA, 1089 bp, Homo sapiens
gaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacagcgggaacttcattgcaggccctgtgtcgcgctgacttcacgattctcacaggcccgctcaatgcggacagggtacgagatgctcacgctctcgaatgctgccgtttggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 4293 - DNA, 1667 bp, Homo sapiens
ttttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 4294 - DNA, 1197 bp, Homo sapiens
atgtcggaggagcagttcggcggggacggggcggcgggcaacggcggcggtaggcgggcgggcgagcaggagggagccatggtggcggcgacacagggggcagcggcgcgggaagcggagccgggaccgggggcggaaccgcgtctggaggcaccgaagggggccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 4295 - DNA, 8274 bp, Homo sapiens
atttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagcagcagcaagtggacatcccccttcggctcctggtgcccacccagtatgtgggtgccattattggcaaggagggggccaccatccgcaacatcacaaaacagacccagtccaagatagacgtgcataggaaggagaacgcaggtgcagctgaaaaagccatcagtgtgcactccacccctgagggctgctcctccgcttgtaagatgatcttggagattatgcataaagaggctaaggacaccaaaacggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaattaaaaaaaaaaaaaccaaaaaaaaaaatttttttttaaaagggagacattttccagtgaccactggattgttttaatttcccaagcttttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatt

SEQ ID NO: 4296 - DNA, 3688 bp, Homo sapiens
ggggggcggaggaggaggagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaaga

SEQ ID NO: 4297 - DNA, 3358 bp, Homo sapiens
atgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagtttttgccttttccctagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtg

SEQ ID NO: 4298 - DNA, 3291 bp, Homo sapiens
cggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaa

SEQ ID NO: 4299 - DNA, 4250 bp, Homo sapiens
ggccgaagccaaaggggttgggaaggaagagacaaaaagtagttttttcccctcctcctcctcctttctcttgctaatcccgcctcctcctaagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 4300 - DNA, 2757 bp, Homo sapiens
gctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatcaaagtaaa

SEQ ID NO: 4301 - DNA, 1215 bp, Homo sapiens
atgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaa

SEQ ID NO: 4302 - DNA, 2507 bp, Homo sapiens
atgcagcgccgggacgaccccgccgcgcgcatgagccggtcttcgggccgtagcggctccatggacccctccggtgcccacccctcggtgcgtcagacgccgtctcggcagccgccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtcctttttta

SEQ ID NO: 4303 - DNA, 2058 bp, Homo sapiens
gcgtcctgttcccgcctctccagttaaggccgctggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaggactctggtcgtggcagaggtattagaggcagagggatcagaatagctcccacagctccttcaaggggccgtgggggtgccattcctcctcccccaccacctggacgaggtgttctcacccctcggggaagcactgtaacccgtggagcgcttccagtgccacctgtagcaagaggtgtccctacccctcgagcccggggggcaccaacagtgccaggatacagggcacctcctcctccagcccatgaagcttatgaagaatatggttatgatgatggctacgggggtgaatatgatgaccagacctatgagacttatgataacagctatgcgacccaaacacaaagtgtgcctgaatactatgactacggtcatggagtaagtgaggatgcctatgacagctacgcaccagaagaatgggccacaacccgctctagcttgaaggcaccaccgcaaaggtcagccagagggggatacagggaacacccctatggtagatattgaaggtccttcccacctgtgacctcacctcaaagacaattcatagcctgtggtctccacataaacagcaacaagacaagtaatagtcctttttttgtttgtttgtttctattctagggataactgctcatgattactcccatatatttctagtatttccctctgtactgttggcgtgacattgacactagtattattttacaaaacagactgaaaaagacattagcaagcatagtctataaacctttcagtaggatgatattctcttggttgtttttcattgttgtgtgtaatcttttttttttctttttcttttttttttttttgaggaaaagcatgaatttgttaacagattttgagtctcaaccaactagcagaaactttgtttagggttgctaaaagactgtaatatgatttttgaactagctgataataaagttgtagataagatgttttaacctgtcttttaatatctgttagttagacaaagatgtttgatattaagtttgtaaatttaattttaatgctgttttaatggggttgaaaacaagcagctactgtatgtatgtagctaactgaatttgttcagtgttttaacctgtatttgttaaaaaagaaaaaaaaacacacataaagttccatgtgtaagcttctctaaataggaaaccacaatttgtcaaatatgtttgccataatttgtcaataaagctgaaaacttttgtaaaaattaaa

SEQ ID NO: 4304 - DNA, 1230 bp, Homo sapiens
gcgtcctgttcccgcctctccagttaaggccgctggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaggactctggtcgtggcagaggtattagaggcagagggatcagaatagctcccacagctccttcaaggggccgtgggggtgccattcctcctcccccaccacctggacgaggtgttctcacccctcggggaagcactgtaacccgtggagcgcttccagtgccacctgtagcaagaggtgtccctacccctcgagcccggggggcaccaacagtgccaggatacagggcacctcctcctccagcccatgaagcttatgaagaatatccatcattaccactttccttgttttttgatacggtggcaaaatctcaccagcattgtgataacgaagtaccacaaactggttcaaccagacttaacccaggacgaagcttttttctggcatggaggtgggagtgggactga

SEQ ID NO: 4305 - DNA, 1977 bp, Homo sapiens
gagtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 4306 - DNA, 9463 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactga

SEQ ID NO: 4307 - DNA, 6964 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 4308 - DNA, 7911 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 4309 - DNA, 1063 bp, Homo sapiens
ggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatg

SEQ ID NO: 4310 - DNA, 5685 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 4311 - DNA, 595 bp, Homo sapiens
agatctagggaggagggaacagcagaggcaaaggcagcttgggagggatgggaaatggaaaatcagggaaacaaacaaacaaacaaacaaaatgaatgagtgaatgtgggcttgaatagtaaaacttccagagagaagacgatgggatctctccccaggtaactacctgtagatgaaaaatagatgaaatacacaaggaagtggcaagcaacaactttgagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttg

SEQ ID NO: 4312 - DNA, 1684 bp, Homo sapiens
agtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaac

SEQ ID NO: 4313 - DNA, 1924 bp, Homo sapiens
acagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 4314 - DNA, 2701 bp, Homo sapiens
cgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 4315 - DNA, 571 bp, Homo sapiens
aaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcagatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccc

SEQ ID NO: 4316 - DNA, 2168 bp, Homo sapiens
tgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 4317 - DNA, 1405 bp, Homo sapiens
atagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 4318 - DNA, 1202 bp, Homo sapiens
gagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 4319 - DNA, 1075 bp, Homo sapiens
cccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgc

SEQ ID NO: 4320 - DNA, 1584 bp, Homo sapiens
aagtagaggcaacttccggtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 4321 - DNA, 765 bp, Homo sapiens
ttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggt

SEQ ID NO: 4322 - DNA, 914 bp, Homo sapiens
gtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacc

SEQ ID NO: 4323 - DNA, 914 bp, Homo sapiens; identical to SEQ ID NO: 4322

SEQ ID NO: 4324 - DNA, 847 bp, Homo sapiens
agccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtccttt

SEQ ID NO: 4325 - DNA, 1075 bp, Homo sapiens; identical to SEQ ID NO: 4319

SEQ ID NO: 4326 - DNA, 1566 bp, Homo sapiens
gtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 4327 - DNA, 1405 bp, Homo sapiens; identical to SEQ ID NO: 4317

SEQ ID NO: 4328 - DNA, 765 bp, Homo sapiens; identical to SEQ ID NO: 4321

SEQ ID NO: 4329 - DNA, 1405 bp, Homo sapiens; identical to SEQ ID NO: 4317

SEQ ID NO: 4330 - DNA, 914 bp, Homo sapiens; identical to SEQ ID NO: 4322

SEQ ID NO: 4331 - DNA, 847 bp, Homo sapiens; identical to SEQ ID NO: 4324

SEQ ID NO: 4332 - DNA, 1566 bp, Homo sapiens; identical to SEQ ID NO: 4326

SEQ ID NO: 4333 - DNA, 765 bp, Homo sapiens; identical to SEQ ID NO: 4321

SEQ ID NO: 4334 - DNA, 1075 bp, Homo sapiens; identical to SEQ ID NO: 4319

SEQ ID NO: 4335 - DNA, 1405 bp, Homo sapiens; identical to SEQ ID NO: 4317

SEQ ID NO: 4336 - DNA, 1566 bp, Homo sapiens; identical to SEQ ID NO: 4326

SEQ ID NO: 4337 - DNA, 1075 bp, Homo sapiens; identical to SEQ ID NO: 4319

SEQ ID NO: 4338 - DNA, 847 bp, Homo sapiens; identical to SEQ ID NO: 4324

SEQ ID NO: 4339 - DNA, 765 bp, Homo sapiens; identical to SEQ ID NO: 4321

SEQ ID NO: 4340 - DNA, 914 bp, Homo sapiens; identical to SEQ ID NO: 4322

SEQ ID NO: 4341 - DNA, 1075 bp, Homo sapiens; identical to SEQ ID NO: 4319

SEQ ID NO: 4342 - DNA, 1405 bp, Homo sapiens; identical to SEQ ID NO: 4317

SEQ ID NO: 4343 - DNA, 1566 bp, Homo sapiens; identical to SEQ ID NO: 4326

SEQ ID NO: 4344 - DNA, 914 bp, Homo sapiens; identical to SEQ ID NO: 4322

SEQ ID NO: 4345 - DNA, 847 bp, Homo sapiens; identical to SEQ ID NO: 4324

SEQ ID NO: 4346 - DNA, 765 bp, Homo sapiens; identical to SEQ ID NO: 4321

SEQ ID NO: 4347 - DNA, 914 bp, Homo sapiens; identical to SEQ ID NO: 4322

SEQ ID NO: 4348 - DNA, 1075 bp, Homo sapiens; identical to SEQ ID NO: 4319

SEQ ID NO: 4349 - DNA, 1566 bp, Homo sapiens; identical to SEQ ID NO: 4326

SEQ ID NO: 4350 - DNA, 1405 bp, Homo sapiens; identical to SEQ ID NO: 4317

SEQ ID NO: 4351 - DNA, 765 bp, Homo sapiens; identical to SEQ ID NO: 4321

SEQ ID NO: 4352 - DNA, 847 bp, Homo sapiens; identical to SEQ ID NO: 4324

SEQ ID NO: 4353 - DNA, 2011 bp, Homo sapiens
gctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctg

SEQ ID NO: 4354 - DNA, 2162 bp, Homo sapiens
gctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 4355 - DNA, 1130 bp, Homo sapiens
atgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataag

SEQ ID NO: 4356 - DNA, 1884 bp, Homo sapiens
tggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaa

SEQ ID NO: 4357 - DNA, 3747 bp, Homo sapiens
gccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctg

SEQ ID NO: 4358 - DNA, 3151 bp, Homo sapiens
ggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgc

SEQ ID NO: 4359 - DNA, 3108 bp, Homo sapiens
gtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 4360 - DNA, 1934 bp, Homo sapiens
gaccggaggatgttccctgctcaggaggaggccgacaggaccgtgtttgttgggaatttagaggcccgagttcgggaagagattctgtacgagctgttccttcaggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaa

SEQ ID NO: 4361 - DNA, 5332 bp, Homo sapiens
ggcgaaggaggtggtggctgcgttgggctccgggaagccgttcgggctggggctgtcggccgcggggcggaggcactcgcgcggggggtaattcggggtctgggttctggtgccgcgcagctttccccggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttg

SEQ ID NO: 4362 - DNA, 5213 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacacttta

SEQ ID NO: 4363 - DNA, 6662 bp, Homo sapiens
gagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgca

SEQ ID NO: 4364 - DNA, 583 bp, Homo sapiens
aaccacgccgttcctcccccttctggaacgcggagccgctgagcgggccgacggccattttgtgaagcggcgaaggaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagca

SEQ ID NO: 4365 - DNA, 1068 bp, Homo sapiens
cggcgaaggaggtggtggctgcgttgggctccgggaagccgttcgggctggggctgtcggccgcggggcggaggcactcgcgcgggggtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcag

SEQ ID NO: 4366 - DNA, 565 bp, Homo sapiens
ctggaacgcggagccgctgagcgggccgacggccattttgtgaagcggcgaaggagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagtt

SEQ ID NO: 4367 - DNA, 2716 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagc

SEQ ID NO: 4368 - DNA, 579 bp, Homo sapiens
cggaggggcagtgggcgccatcttcttctgggctcactgagggtctacctgttttggggaggctgctgcgacgaagagttccctcagcctccggccttgtgtgtccgactcggcagcagtggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggc

SEQ ID NO: 4369 - DNA, 7269 bp, Homo sapiens
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggaggccccttgaggaggactggaggcggccactggaggaggatttcaggcggtctcccacggaggacttcaggcagctccccgaggaggacttcaggcaaccccctgaggaggacttaaggtggctcccagaggaagatttcaggcggccacctgaggaggactggagacggcccccagaggaggactttaggcggcctcttcagggagaatggaggcgaccacccgaggatgacttcaggcggcccccagaggaggatttcaggcattcccctgaggaggacttcaggcagtcaccccaggagcatttccggaggccacctcaggagcatttccgtcggccacccccagagcatttccggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgttaagtagtgaccttgctgcctctgtttttgcagtaaatattagctgttgtttattgagctgtattagatactatatgatgtataattatgtatgaattaactatcatttaattctgataatcctagtaaatgtactacaggttgagtattcctaatctggtaatctgaaatttcacatgctccgaaaatcacaaactttttgagtgccaacatgatgctcaaagaaaatgctcattgcagcatttaagatttcagatttttgggttaggaatgttgaactggtataatgcaaatactccaaaatctgaagaaatccaaagtcttaaatacttctggtcccaagcacttcagataaaggatactcaatttgtattcctattttggagataagagatggagacttacaggctgggttggttggattggttgcctgttttttgttgttgttgtagtggaagctaggaatggtttttcacattttttaagtgtacttaagtcttacatggttacatagttacctgtataatagtcttgaatttgcctaaacccacgaagaataacagtatttgctatctggccctttaagaagtttgccaacctaggctggtctaaataatgaaaattttacattaatgaaagtattttcatggatagtattccttttgttcttagaatatttctttgaggtaggcagaatgtatgttttattccagaattactgttttacgcagttttaactttacaaacaaggcaaataatgctcaagagaagttgctatttagtaagcagcaaaataataactctgttgttttcccccgaagtacaaccaaatttaaatactgagtgaggaagcagtaaatatccaatgatatcttgagtttcttaagaatatcaatttagggttttaaa

SEQ ID NO: 4370 - DNA, 588 bp, Homo sapiens
tacctgttttggggaggctgctgcgacgaagagttccctcagcctccggccttgtgtgtccgactcggcagcagtgcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatg

SEQ ID NO: 4371 - DNA, 452 bp, Homo sapiens
gggcgccatcttcttctgggctcactgagggtctacctgttttggggaggctgctgcgacgaagagttccctcagcctccggccttgtgtgtccgactcggcagcagtggtgtgtgtttattgccaattaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactat

SEQ ID NO: 4372 - DNA, 6001 bp, Homo sapiens
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgtt

SEQ ID NO: 4373 - DNA, 615 bp, Homo sapiens
ccgactcttcctttcccgtcagcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccat

SEQ ID NO: 4374 - DNA, 2828 bp, Homo sapiens
attggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 4375 - DNA, 4244 bp, Homo sapiens
gcgcgcggggggcggggctccccccggctgttcactcagctaccacagcgacgtaaaatggtgtccgctaggcgtcccaggacggcttcctgagggactggagggccccgacagccggaaagcctgccccgccccttggccggcacaggtacgacggcggggagctcagaagtttcgaactccaagggccgaagcacagccaaacaccccacggaacttaacaaatgtttgtggggagaacgccgaaaacgcggggaggcggggctggcgcacagtcaccctctcgcgacatctaagtgacgtcgcacagcaagcacgtgttctagtctttcaccttcagtcagcctcctccgttatacaggcctacccctttaagcgagtgatggacagttatttcagcctatcaacttccttgccgacatccaatcagatttaaacttcttttagccgccggaggagttggaaaaagggggtcgaaagagggagcttaccgtctctcgcgatatcgctgtgagcctgcctctctggaaaaaacgccgaaactgatggcccgacctcccaaatagtggtttaaaggacgggtttataagccaatgaaagggataaggaggtgggttgctgctgtcactgagcaagaagtaccgttacagggcagactttttgtccaatcaacacctcaacactttgggtcacgtgaccgcagagtgcgaggggcggagctacagtctggcgcgaggaaccgttaagatagacaacaaatgtaaccaatgaggtactccgactagggggttgggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaa

SEQ ID NO: 4376 - DNA, 6600 bp, Homo sapiens
gtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgtgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacatt

SEQ ID NO: 4377 - DNA, 1669 bp, Homo sapiens
gagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggattttt

SEQ ID NO: 4378 - DNA, 2446 bp, Homo sapiens
gccgccgctgtgagaaacctacgggccgcccgcccgccgcgccagcgccatgaagcggcagagcgagcgagactctagcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgca

SEQ ID NO: 4379 - DNA, 1116 bp, Homo sapiens
cgccgccgctgtgagaaacctacgggccgcccgcccgccgcgccagcgccatgaagcggcaaagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgca

SEQ ID NO: 4380 - DNA, 676 bp, Homo sapiens
ttcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatg

SEQ ID NO: 4381 - DNA, 844 bp, Homo sapiens
gcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaa

SEQ ID NO: 4382 - DNA, 3192 bp, Homo sapiens
gcaggcgcaggcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgtaaagtaagttggggttaaggaatgtgaggtaaattacataattgaacattgtggaagacagaatcaaaagcagccctggaacttcagttatctatggaattaggcataccattcctcaagtggaaaccatgtttgtgcttacaagtaccggagtgtgcttgtttaattttagaaactaatggttccaacccacctttcatgcatgcatttattgttgttatgctttgtaaaacattgtttgcacctaaatgggtggcttttcctaacattctcatggtcagcaaccagagagttgcaaccaactcatactacttgatttccgttcgcatgaggacagcttggtgtgtgcctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggc

SEQ ID NO: 4383 - DNA, 792 bp, Homo sapiens
aatggtaccaggagcctgggcctctgttgctgaaaggtcctggaccttttacctctaaaatttcatgatacttattttaacatgaaaagcctttattgaattgtgcattctttaatccccaccccttttgcctttcagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctccccca

SEQ ID NO: 4384 - DNA, 805 bp, Homo sapiens
gaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaagcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctc

SEQ ID NO: 4385 - DNA, 2755 bp, Homo sapiens
caggcgcaggcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaa

SEQ ID NO: 4386 - DNA, 3751 bp, Homo sapiens
agtccccgcggcgggcgctggtctctccacgcggctgcggcccggtaccctccgcccgccgccgcctctggtgaccctggccctgaccttctccctcttcccttcctcctcctcctcctcatgtctgcctcgggctgtttggtgctgaagagcgtttcttctccgtctcgtgcaccgcatcctgacgaaattgtctggtcaccagaaccgagtagcccgtagcgtgtcccccctggccctgcacggttgcccctctctggggctcggagccggttcctcccggggtctcagaactgggagtgcagacgttggcgtttctcagactccggagctgcccgggacaggaatgcagccctaaccccggcgtcgcctcggctcgtgcagtttgagcggtgtttcagcgctcacgtccgaccccaggcagtctttgagcttcgcctcttgccccgagaatgtgtaatgatcggagaatgcaggtggaatgaggttctgcccctgcttgcaggagtttggtttctgggaaagcaggcgtgaaaacccaggcccgggttgatttgagaaacgcaagtggggtctggaaggacctctcttgagagaggaggtcatgcttatgttgagtcttgaagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgtaaagtaagttggggttaaggaatgtgaggtaaattacataattgaacattgtggaagacagaatcaaaagcagccctggaacttcagttatctatggaattaggcataccattcctcaagtggaaaccatgtttgtgcttacaagtaccggagtgtgcttgtttaattttagaaactaatggttccaacccacctttcatgcatgcatttattgttgttatgctttgtaaaacattgtttgcacctaaatgggtggcttttcctaacattctcatggtcagcaaccagagagttgcaaccaactcatactacttgatttccgttcgcatgaggacagcttggtgtgtgcctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggc

SEQ ID NO: 4387 - DNA, 3043 bp, Homo sapiens
taacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgtttgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtgtccgtgtggttatatcttctctcgttcacttactggcatagactgcagttctctgacaggcttgtttccactcaggactctggccagcatgtccacgtggggtgcttcttctaagtgccttctctgcagagggttctggctagagagtcaaactgagaggcaactctctttaccctttatgcctgcctacctctgttgttagagatgagaatagagaccagctgtttccattgcaaatgtcactatttgaaaagaagttgttaatggaaatctctgcaagtatcgtactgtgtttagtctctcgtggtagagatttcaaaagaagaaatgtatgtatcctaaatatgctgaaagcagtctgatgaaaggtttttaaatttcaggtgttaacttggtcaactctttgttaggaggttgtctgtactttaagtaaaattattctttggtttactggt

SEQ ID NO: 4388 - DNA, 4422 bp, Homo sapiens
cgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggctggagtgcagtggcgtgatctgggctcacctccctggttcaagcgattgtcccgcctcagcctcccaaggctgggattacaggtatgcaccaccacgcccggctaattttgtatttttcatagagactgggtttcaccatgtagaccaggctggtctcgaattcctgacctcaagtgatccacctacctcggcctcccaaagtgtggggattacgggtgtgagccaccacgcccggctaattttttgtatttttagtagacagggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcgcagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcacgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatag

SEQ ID NO: 4389 - DNA, 4194 bp, Homo sapiens
cttccggacaggtcaggccaaggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatca

SEQ ID NO: 4390 - DNA, 3571 bp, Homo sapiens
gcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatca

SEQ ID NO: 4391 - DNA, 7271 bp, Homo sapiens
ccgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaatgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaagattatgcctcaaatcttggaacatcatacgtgcccattccagcaaggtcattcactcagtcaagccccacatttcctttggcttctgtggggacaacttttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagaaacccgggaaggccgtggctgccatcatccaggacatccattcccagagggagagggacatgttccgggaagcagacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtgggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggctggaaaagaggaacaggagggcatggaagaaagccctcaatcagtgggcagacaggagaaagaagcagagttctctgatccggaaaacacaaggacaaagaaggaacaagattgggagagtgaaagtgaggcagagggggagagctggtatcccactaacatggaggagctggtgacagtggacgaggttggggaagaagaagattttatcgtggaaccagacatcccagagctggaagaaattgtgcccattgaccagaaagacaaaatttgcccagaaacatgtctgtgtgtgacaaccaccttagacttagacctggcccaggatttccccaaggaaggagtcaaggccgtagggaatggggctgcagaaatcagcctcaagtcacccagagaactgccctctgcttccacaagctgtcccagtgacatggacgtggaaatgcctggcctaaatctggatgctgagcggaagccagctgaaagtgagacaggcctctccctggaggattcagattgctacgagaaggaggcaaagggagtggagagctcagatgttcatccagcccctacagtccagcaaatgtcttcccctaagccagcagaggagagggcccggcagccaagcccatttgtggatgattgcaagaccagggggacccccgaagatggggcttgtgaaggcagccccctggaggagaaagccagcccccccatcgaaactgacctccaaaaccaagcttgccaagggtctgacagtgatacaagacttgtttcaggatattctctcactccattggagaaaactccaggtacgtggaaatgaaatctctggaggtgaggtcaccagagtacactgaagtggaactgaaacagcccctttctttgccctcttgggaaccagaggatgtgttcagtgaacttagcattcctctaggggtggagttcgtggttcccaggactggcttttattgcaagctgtgtgggctgttctacacgagcgaggagacagcaaagatgagccactgccgcagcgctgtccactacaggaacttacagaaatatttgtcccagctggccgaggagggcctcaaggagaccgagggggcagatagcccgaggccagaggacagcggaatcgtgccacgcttcgaaaggaaaaagctctgatgcttctgcttctgctgctactgctgctgctgcaaggttggaaaggagagcttgctgaagtggggccttcctgattctggggacaggactaaagcctgagaggaaggaaaaccaagcagggcacattgcttgggcttgttcccagagactcagtgaaatgcccctgatatgtctccaggagcaagtcacccaggtgtgtccagcccactgagggtcaccaactctctccctgctgactcttgtttctctcaatctttcaattcgtttttctctcttttcctcttgttctttctctccctccctccttatgtgccaaggatcgtttccttttcacaaaacccaacttctcagggattttcacagtgtttaaattcttggtaggatataacaggtcaggcctagctgagtcaggcaaggaaaaggtttaatggaaactcctgggtcaggcgaacccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatcttcctccagctaaagcagcagttggcgcgggcttaggttgaatgctggcctctctgcaaagcacagctttggctcgagaggcacagctccaggctgtggaaaacagagttgtcttgggggttaaatgagcttatttaagtcaaggaaacatcatctgtccttgattcagccttggtgcctgcactctggggtacaaccacctcacagtaggatggtttttaaatggccccccagttgggggagaagctaaggaaagagaaggctgcagatccaaagagtggcattgaagtttgctgggtgtctgtaggtggaccctttccagctgggcagatagttgagggctccctgggtttgactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttttgagaagaccatatgggggctgctgaaaagttggtatctcaaataaagtctgaagatcacggctcagcccagattgttcccctggccaactccacaggtttgaacctggcattctggacaccagctatgcctcctccatttctcagaaaacctttgatcttgtgtgtctttcttcctactgaagggaattgtgggggcagttctttggccttcttgctgaactttgctggaaatagcccacaatttttatcagaggttagaactgtacattatcagagagactggacactttatcccctagcaaagtgggagaagattttaccagctcattccactccaccctggccttcccccaccccccatccccagcagcatttccatggaaatccagatggtcgtgtagtgttatggctctcttgtgatagactggccttcatattggagagctagggagagcccctgggagggagagagataaggcgctatctgccttcaatcagaaccttcggtttaaaatcatctaagagtctatacttgtgtgtacatacgtatttatttttatttatttttatacaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgt

SEQ ID NO: 4392 - DNA, 7233 bp, Homo sapiens
ccgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaatgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaagattatgcctcaaatcttggaacatcatacgtgcccattccagcaaggtcattcactcagtcaagccccacatttcctttggcttctgtggggacaacttttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagaaacccgggaaggccgtggctgccatcatccaggacatccattcccagagggagagggacatgttccgggaagcagacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtgggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggctggaaaagaggaacaggagggcatggaagaaagccctcaatcagtgggcagacaggagaaagaagcagagttctctgatccggaaaacacaaggacaaagaaggaacaagattgggagagtgaaagtgaggcagagggggagagctggtatcccactaacatggaggagctggtgacagtggacgaggttggggaagaagaagattttatcgtggaaccagacatcccagagctggaagaaattgtgcccattgaccagaaagacaaaatttgcccagaaacatgtctgtgtgtgacaaccaccttagacttagacctggcccaggatttccccaaggaaggagtcaaggccgtagggaatggggctgcagaaatcagcctcaagtcacccagagaactgccctctgcttccacaagctgtcccagtgacatggacgtggaaatgcctggcctaaatctggatgctgagcggaagccagctgaaagtgagacaggcctctccctggaggattcagattgctacgagaaggaggcaaagggagtggagagctcagatgttcatccagcccctacagtccagcaaatgtcttcccctaagccagcagaggagagggcccggcagccaagcccatttgtggatgattgcaagaccagggggacccccgaagatggggcttgtgaaggcagccccctggaggagaaagccagcccccccatcgaaactgacctccaaaaccaagcttgccaagaagtgttgaccccggaaaactccaggtacgtggaaatgaaatctctggaggtgaggtcaccagagtacactgaagtggaactgaaacagcccctttctttgccctcttgggaaccagaggatgtgttcagtgaacttagcattcctctaggggtggagttcgtggttcccaggactggcttttattgcaagctgtgtgggctgttctacacgagcgaggagacagcaaagatgagccactgccgcagcgctgtccactacaggaacttacagaaatatttgtcccagctggccgaggagggcctcaaggagaccgagggggcagatagcccgaggccagaggacagcggaatcgtgccacgcttcgaaaggaaaaagctctgatgcttctgcttctgctgctactgctgctgctgcaaggttggaaaggagagcttgctgaagtggggccttcctgattctggggacaggactaaagcctgagaggaaggaaaaccaagcagggcacattgcttgggcttgttcccagagactcagtgaaatgcccctgatatgtctccaggagcaagtcacccaggtgtgtccagcccactgagggtcaccaactctctccctgctgactcttgtttctctcaatctttcaattcgtttttctctcttttcctcttgttctttctctccctccctccttatgtgccaaggatcgtttccttttcacaaaacccaacttctcagggattttcacagtgtttaaattcttggtaggatataacaggtcaggcctagctgagtcaggcaaggaaaaggtttaatggaaactcctgggtcaggcgaacccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatcttcctccagctaaagcagcagttggcgcgggcttaggttgaatgctggcctctctgcaaagcacagctttggctcgagaggcacagctccaggctgtggaaaacagagttgtcttgggggttaaatgagcttatttaagtcaaggaaacatcatctgtccttgattcagccttggtgcctgcactctggggtacaaccacctcacagtaggatggtttttaaatggccccccagttgggggagaagctaaggaaagagaaggctgcagatccaaagagtggcattgaagtttgctgggtgtctgtaggtggaccctttccagctgggcagatagttgagggctccctgggtttgactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttttgagaagaccatatgggggctgctgaaaagttggtatctcaaataaagtctgaagatcacggctcagcccagattgttcccctggccaactccacaggtttgaacctggcattctggacaccagctatgcctcctccatttctcagaaaacctttgatcttgtgtgtctttcttcctactgaagggaattgtgggggcagttctttggccttcttgctgaactttgctggaaatagcccacaatttttatcagaggttagaactgtacattatcagagagactggacactttatcccctagcaaagtgggagaagattttaccagctcattccactccaccctggccttcccccaccccccatccccagcagcatttccatggaaatccagatggtcgtgtagtgttatggctctcttgtgatagactggccttcatattggagagctagggagagcccctgggagggagagagataaggcgctatctgccttcaatcagaaccttcggtttaaaatcatctaagagtctatacttgtgtgtacatacgtatttatttttatttatttttatacaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgt

SEQ ID NO: 4393 - DNA, 1386 bp, Homo sapiens
caattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataa

SEQ ID NO: 4394 - DNA, 2342 bp, Homo sapiens
aagaagccctagacgcgtaaataagacgccgaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 4395 - DNA, 2128 bp, Homo sapiens
gtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatggaaagggaaaaatcaggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 4396 - DNA, 2430 bp, Homo sapiens
atgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaa

SEQ ID NO: 4397 - DNA, 2601 bp, Homo sapiens
gcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatca

SEQ ID NO: 4398 - DNA, 2361 bp, Homo sapiens
gcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaac

SEQ ID NO: 4399 - DNA, 588 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgagtcttggtctgtcacccaacctggagtgcaatggtgccatctcggctggctgcaacttccgcctcccgggttcaagcaattctcctgtctcagcctcccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcag

SEQ ID NO: 4400 - DNA, 268 bp, Homo sapiens
gaaaaaactaccagcctgaaaatgcatagtgtttgctaccttattgcttttagcacatctagaaagacactaaacccaatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaag

SEQ ID NO: 4401 - DNA, 573 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggccgggctcggtggctcatgtctgtaatcccagccctttgggaggaccaggcaggcggatcacctgaggtcaggagttcgagaccagcctgaccaatgtggagaaaccccgtctctgctaaaaatacaacattagccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgt

SEQ ID NO: 4402 - DNA, 582 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgggtcacacattgctgcccaggctggagtacagtggcgtgatcttggctcactgcaacctccaccttttgggttcaagtgattctcctgcctcagcctcctgagtagctgggattacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggac

SEQ ID NO: 4403 - DNA, 2601 bp, Homo sapiens
ggcgcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatc

SEQ ID NO: 4404 - DNA, 581 bp, Homo sapiens
attttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggag

SEQ ID NO: 4405 - DNA, 457 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggat

SEQ ID NO: 4406 - DNA, 571 bp, Homo sapiens
attacaggtgtgtgccaccacacccagctaatttttatatttttggtagagggggtttcgccatgttggccaggctggtctcaaactcctgacctcaggtgatctgcctgccttgccctcccagagtgctaggattacaggtgtgagccactgcgcccggactatccttgactgttccaagccacaaagtcgaactagttcagatctatagggtgtaaaaataaacctagagtaagtgacagctggtaaggtttctttgcagttcaagaaacagaactgaaatctgtatatcctgaagtctctttcttggagtgggaaagaaatgtgtggtgctggaaagggaggaaaaatataaaacagattcttacatattaatatcctctccccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggaga

SEQ ID NO: 4407 - DNA, 569 bp, Homo sapiens
aagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaag

SEQ ID NO: 4408 - DNA, 583 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgg

SEQ ID NO: 4409 - DNA, 2703 bp, Homo sapiens
ggagagagcgaagtcaagtctccagggccgctggcgacttcggaagccgcgcgcccggcgctctcggccgcccccggccgctcgcccccgccgcgccgccgccctcgcccccgggctcgcccttggcccccggcggccgcgaaagggtgcgggagacgcggagccggaggaggaggcgcagccgctgcccgagccgcagccgcagccggagcccgagccgcggggcgggtgcgaagatgcacacgacccagaaggacacgacgtacaccaagatcttcgtcggggggctgccctaccacaccaccgacgccagcctgcgcaagtacttcgaggtcttcggcgagatcgaggaggcggtggtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttc

SEQ ID NO: 4410 - DNA, 2394 bp, Homo sapiens
gatctcagttttatcatgaatgacttctccattgtgattcttgatttccttcatgggttaatttagaggttatgtatgtatgtctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataattttt

SEQ ID NO: 4411 - DNA, 1034 bp, Homo sapiens
acaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaa

SEQ ID NO: 4412 - DNA, 541 bp, Homo sapiens
agaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaag

SEQ ID NO: 4413 - DNA, 2470 bp, Homo sapiens
ctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 4414 - DNA, 1039 bp, Homo sapiens
aagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggacggagtcttactctgtcgttcaggttggagtgcagtggcgcgacctcggctcactgcaacatctgcctcccaggttcaagcaattctcctgcctcaccttccagagtagctgggattacagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggac

SEQ ID NO: 4415 - DNA, 4426 bp, Homo sapiens
tggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttt

SEQ ID NO: 4416 - DNA, 3375 bp, Homo sapiens
gaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggggtctttctctgtctctcagcctcaagccatcctcctgcatcagcctcccaagtagttgggaccatagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtcctt

SEQ ID NO: 4417 - DNA, 1567 bp, Homo sapiens
cgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 4418 - DNA, 1093 bp, Homo sapiens
agtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaa

SEQ ID NO: 4419 - DNA, 3624 bp, Homo sapiens
tagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaa

SEQ ID NO: 4420 - DNA, 3693 bp, Homo sapiens
tagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcagaatgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctcttt

SEQ ID NO: 4421 - DNA, 3621 bp, Homo sapiens
tagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctcttt

SEQ ID NO: 4422 - DNA, 6451 bp, Homo sapiens
gggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagaggtatttcaggagccagcagaggaagaacgagatggcagaaaaaagaaatatcctagtccccagaagactcgttcagaatctagtgaacgaaggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacgacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccagatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattgg

SEQ ID NO: 4423 - DNA, 2808 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaat

SEQ ID NO: 4424 - DNA, 547 bp, Homo sapiens
cttcccacatgctttcagaagtggagcatgcctcatttctttctcttgcttttcatcattgtccatatcaggtcattttcagtcaggcacaggaagtgcagttttccactgtagtttggataggttcagtactctaaaataaaaccagtcactgcagatagatttccattgcagaagattcttccataaagaagtgatctgtagaacacttgcttctttatcccaccatatagtcttattagttgtgcagggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggag

SEQ ID NO: 4425 - DNA, 1404 bp, Homo sapiens
cccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaa

SEQ ID NO: 4426 - DNA, 10149 bp, Homo sapiens
atgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtgggggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcc

SEQ ID NO: 4427 - DNA, 7058 bp, Homo sapiens
attgcagaagattcttccataaagaagtgatctgtagaacacttgcttctttatcccaccatatagtcttattagttgtgggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctg

SEQ ID NO: 4428 - DNA, 2054 bp, Homo sapiens
gcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaacctta

SEQ ID NO: 4429 - DNA, 1488 bp, Homo sapiens
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgct

SEQ ID NO: 4430 - DNA, 667 bp, Homo sapiens
gcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaa

SEQ ID NO: 4431 - DNA, 1852 bp, Homo sapiens
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaacctt

SEQ ID NO: 4432 - DNA, 2382 bp, Homo sapiens
gcagcgccggtcgggagcgcagcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 4433 - DNA, 686 bp, Homo sapiens
gcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcc

SEQ ID NO: 4434 - DNA, 760 bp, Homo sapiens
ataaacatcagcttaagtaaaaacgtcttgaagacactttcctgcttaccttccaagcatagcgtcgcaaactccttctcagaggaaagtctcggccctcactggtgggcaagtccaggcggccccccaagctcccttcggggttcatttttgccctatccccgcaggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgcc

SEQ ID NO: 4435 - DNA, 2488 bp, Homo sapiens
ggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 4436 - DNA, 2147 bp, Homo sapiens
gtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagg

SEQ ID NO: 4437 - DNA, 2831 bp, Homo sapiens
gcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 4438 - DNA, 1008 bp, Homo sapiens
aagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgc

SEQ ID NO: 4439 - DNA, 1026 bp, Homo sapiens
gtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaa

SEQ ID NO: 4440 - DNA, 2109 bp, Homo sapiens
cctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttacagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttc

SEQ ID NO: 4441 - DNA, 2792 bp, Homo sapiens
gccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagctttgtttgttattatgttttggaatgaaatttggtcagataatatgattacgcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 4442 - DNA, 716 bp, Homo sapiens
ggcagcgcgggtttttgcccggaaagaggcgctctcgttcgggtctcccagtttctgtttttggagttgacagcagagttttaaatattggatattgaagtcttcattttcgtgtgtttcgtgcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaa

SEQ ID NO: 4443 - DNA, 757 bp, Homo sapiens
aggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggactta

SEQ ID NO: 4444 - DNA, 1763 bp, Homo sapiens
actgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataa

SEQ ID NO: 4445 - DNA, 2321 bp, Homo sapiens
accttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 4446 - DNA, 1548 bp, Homo sapiens
gttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaatta

SEQ ID NO: 4447 - DNA, 1694 bp, Homo sapiens
actttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 4448 - DNA, 680 bp, Homo sapiens
ggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaaggtattatacctgaagaaccttagccctcgggtgactgaaagagatcttgtgtcattgttcgctcggttccaggagaaaaaaggacctccaatt

SEQ ID NO: 4449 - DNA, 1662 bp, Homo sapiens
acccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaa

SEQ ID NO: 4450 - DNA, 2579 bp, Homo sapiens
aagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattacc

SEQ ID NO: 4451 - DNA, 672 bp, Homo sapiens
gacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaaggcatcattcccaacccaccataa

SEQ ID NO: 4452 - DNA, 990 bp, Homo sapiens
gacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatag

SEQ ID NO: 4453 - DNA, 1649 bp, Homo sapiens
ggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcc

SEQ ID NO: 4454 - DNA, 1562 bp, Homo sapiens
ggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcc

SEQ ID NO: 4455 - DNA, 4192 bp, Homo sapiens
cgggtggaaggaccgcccttttcttcgtagcctccaagggagctggaacaaaaaacgaaaccaaaacctgcctgctcgctcctctccccatcgcctgcgttccgctggttgtgggctttctgcggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaagatcttcagctctgtaaatgccatccttgatctttctgtttttggaaaagaagttactctagaaactctggtaaaagacctgaaaaaaaaaatcccgagtttaagcttcagtcctttgaaacccaatggaagaatctccgtggaaggatcatttctggctgtcaagaggctcagagaatctttgctagcaagagcatgttctctcttagaaaaagacagaaattttaccagtgaggagagaaagtggaatagacaaaatccccagaggaatctacagagaagtaataactctttggcatcagtcaggaccttagtacctgagactgctagaagtggagaaatgcttgtgcttgacacagatgtttttctttacctgaaacacaagtgtggatcttatgaaagcacactgaaaaaattccacattctgagtcaggagaaagtggatggtgaaatcaccacaatttgtctaaaaagcattcaagttggttctcagccaaacaatgcaaaacatgtaaaagagctcattgaggaatggtcacatgctctttacttaaagcttagaaaagagacatttattttggaaggaaaggaaaatagagagaaaagaatgatcaaaagggcatgtgaacaattaagttcgagataccttgaagtcctgattaacctttataggacacacattgacattataggatcttcttctgacacttacctgtttaaaaaaggggtcatgaaattaatagggcaaaaggttagttaataaaatctcagcaatatagtcataagggctgctttctcttgctgagcagtgaccattgccatgaatgaggctagctttacacaccgtatctcatgaatccttatagtcatccttctttgtcagtgttgactatcctcatgttacagcggaagaaactaggatttggagaagttaaaacacttttctgaagttatccagttgacaaagaatgaggctgtggcttagcccagtctatctgattacacagataatatctaaggaataaaactttgaaaaaaactcaccaaacttttttttttttttttttgagatggagtctcgctctgttgtccaggctggagtgcagtggcgtgatctcggctcactgcaacgtccacctcctgggttcacaccattctcctgcctcaacctctggagtagctgggactacaggtgcccaccaccacgcccggctaatctttttgtatttttttagtagagatggggtttcaccgtgttagtcaggatggtctccatctcctgaccttgtgatccacccgcctcggcctcccaaagtgctgggattacaggcgtgagccactgcgcccagcaaactcaccaaactttgaaggaatcttactttctctgtaactccaaattattagagaataataattattaagaagtagccttaacatatgagaaatttgaaaggtgattattatgccatgggcaatttcttaacatttacagtttgtgtttactccgtgtagaattagaatactggcaaaaatcactggggaaactacttagatggaaagcatatcttatgcaggtaatcattatttgactaaattctattgtttcaaggctgctggccacataggatgtttttactatttttttagcctaagtgcttacataaaatggtgattcttttataattgtgcaagttgataatattaattgagtcattcttgtcacatccaactaaaacagactcaagaagctagggggaaaaagtacttgggacacataatattgctccaagaatgtaattctctgtgagcctggctactgaaactgcttgctgtaacctgagaccagttttgtctatagctgctgagataacttgctgtaactctaggactaattttacctatggccattgcccaccagttggagcttgccagctccccagggctttactaataccaatgaactttctcttaagatcacaagttggccgggcgtggtgactcatacctgtaatcccagcactttgggaggccgaggcgggtggatcacaaggtcaggagattgagaccatcctggctaacatggtaaaaccccatctctactaaaaatacaaaaattagccgggcatggtggtgggcgcctgtagtcccacctactcgggaggctagaggctgaggcaggagaatggcgtgaacccgggaggtggagcttgcagtgagccaagactgcactactgcactccagcctgggtgacagagcgagactccgtctcaaaaaaaaaaaaaaaaaaaaaagaaagaccacaagtaacattcttagttttaaataaaaccctcaaccttctctttgtttgttggacatactaaagatcacctagaattgaaattctttcttctcaaaacattaaatttagttttgtgtctacattttcattttgactttgacatgcatggtgtcagaagtgggatacaaagctgactcacctcatggagaatcattggcctttggagttatggcatgaggtacccatgttggggccctttgaaccccctacacccccaccactttcacaggtaatcctttctccctccagtaagtatctcttggacagaactctcagatatggttcgagttctgttttatttgggatatgattagggagaggtctttccccctcttgtttggtagatctgttgggtagaattattttccccctgttgacctcagctgcgaggtttggaccttgaggcttggatgagggaatttttccctttctttggagaaggcttatcattcttactggtaagcatgtattttattttctgtcctgtcttgtatttatttggcctttgtgtattcagtgcttgcatttacttggcttttgcatagttgacattaaatcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgaggctaaaaaaaaataaaaacaaaaacaaaacacattcaggatacaaatattgccttgttaaaaaatactgtctcaaaggtggctgaaactttcttttctagacctttcccctccccttcttacagtatcccctctttatccttctctaaacagctattctaacatactacttaaataaaaacacttgaaaaccagcagatataaaacaaagtcattttgaccttcctactgttttttttttaaagcaaagattaaattcccatgtaaaaccttcctccctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggtgaatttacgtgttttactatatcatgactaaaattctaaaataaaagttttaatatcttta

SEQ ID NO: 4456 - DNA, 4282 bp, Homo sapiens
gttacccaacaggcgccgcggctgctccggtggcgccactgactcggaggcggctgcggagagcggggcgctggcccgtggaggcggcagcggcggcggctttctagcggatccgagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagagaacttccttggaaagtgtgtttcctccttcagagaatgttctacagcacttaggaaaaagtagtaataacaagatgatgtaattaaataggctctataaatgggctaagctgttaaaatattctactttatatccctcctttaaaatctagcaacagttgtctatacaatattaagatcttctctatatatttaaagttaaaatataatttttaataagtttttaaatttttttatttcaattttgttacttagaacattaagatgcatatttgtgatctaaagaaattgtcttgtccattttaaaaacctttattaagtcacttttaaaatgtattgaccaagaaggaggtttgttgttacatcaatgtttgtgaaatgatttccatacataaaaaatgtaatttacctgaactttgtcttaagactcttacattggattataggataacagataaataaactgtatagatacattcagtatcatacaacattttggaatgtgtatgctttcaggcttccaagataattaaattactgtcatgatacatttcatgcattttttatgacttcagtataaaacattcaggtgtgttagccttccctgggaagggtaaacttgtatgtgctttggtaaagtacttaaattccaatgttccctatagtgcttgcattcattttgtgaaaagttttgttgtattgttagaacaattttcaaaggctgattttatgccttatctgatagaaatatagaatagatagttctttaattgcttactttttaaaagtaatataatatttaagttgcatttttattaatagtaagattaacatttaagtctgcattttctttaaatgttttaaatgtttatagcattcaatgtgtagttggatttacttgactaaaaattagccctttaacgtttatatttgttgtatttatatttaataaaggcatctaatctttagt

SEQ ID NO: 4457 - DNA, 3449 bp, Homo sapiens
gaaattcgcacatatgcttcttcttgccgtggagactgatggagcctctgctgcggggcggggactctagcgagagggggacgtgaagttcgttccgtactcaggcgtgtgtgcccctgaccgacgcgtaggacgccctggaggacggcgccagctcctgacctagtgtgaggtgcccggacggtttccctaagaagcgcgtatttaagatgagatctgaagttgagcgtgaactcaagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagaggtaaagtaatcata

SEQ ID NO: 4458 - DNA, 1785 bp, Homo sapiens
cgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagatctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 4459 - DNA, 757 bp, Homo sapiens
cacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaatgaaatgagtctaacacc

SEQ ID NO: 4460 - DNA, 2583 bp, Homo sapiens
gattggatgaggcaccactcctcgtggggctgcttaggccaccgcgcgcgctgcgcgctgggaaacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttggactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcaggcctccttcttctgaagaaaatactaacattagtatgaaaatttgtgtaaatttgtagtatgaaaacttgcaaattaaaatattgttttattttagaatcgggtttgcatatttggttttaaaaaggtatttattccaaagtactaaacatcagctataattcagaataacatggagttgtagaatttataaaaatgcaaagtttaaaaagttattcagtggtttctcttgataaaggtacagcaaactactattctttttaaacttctaggattttcttctactttctgagtgggcaatagaacctagtcatttatgtttttttttttttttgcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttcta

SEQ ID NO: 4461 - DNA, 4056 bp, Homo sapiens
agactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaa

SEQ ID NO: 4462 - DNA, 4816 bp, Homo sapiens
aaggggaagtgtggaaatagagcctgcttgttcattttcattattgtacattacatgatatcttttcgaccattatattgtgttccctcagtggtgtttgctctgagggtgggacacaagcctgtttagtgtctcgtaaaacatttaccaaaagcactgagccatggtttttgaagggcattccgttgccagagtgtgggaggagagagcaagcagggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 4463 - DNA, 657 bp, Homo sapiens
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcc

SEQ ID NO: 4464 - DNA, 1100 bp, Homo sapiens
taatttctccaacgtggttctggctgggtttctcggagcagcccgaagggggccgagcgtctgactcggacagatgcccccaggtggagcaggtgccacttctgggtgtctgaaaggcatgtgacttttggggcggggagagaagtccgtctggtcaagtcccccaatctctgccatcaaggccgattttctttgaaccttcagcaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggcc

SEQ ID NO: 4465 - DNA, 836 bp, Homo sapiens
gtcacagaattcgattcctgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgc

SEQ ID NO: 4466 - DNA, 882 bp, Homo sapiens
gggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttgagacagggtctcactatgttgcccagactggtctggaactcctgagctcaagcaagcttctcacctcagcctcccaaagtgctgggattataggcttcagccaccacgcccaaccagccaggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaac

SEQ ID NO: 4467 - DNA, 856 bp, Homo sapiens
ccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccc

SEQ ID NO: 4468 - DNA, 797 bp, Homo sapiens
tgaaccttcagcaaaggtatctgcgctcctaaaaaacaacaggaatgtggcactggcctttagccaggggaggctcagccagcaggataaaatttcagggcagatttacgggaagttgccggtgttgggagtaaaaatctggtttgctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcc

SEQ ID NO: 4469 - DNA, 4934 bp, Homo sapiens
gcagactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagaccttattttaaattgtg

SEQ ID NO: 4470 - DNA, 582 bp, Homo sapiens
gcttaagcaaagctttcattacagttagcctgtcgcacccagatcaagattggaaaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggc

SEQ ID NO: 4471 - DNA, 4473 bp, Homo sapiens
agtcagacccaggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 4472 - DNA, 741 bp, Homo sapiens
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgc

SEQ ID NO: 4473 - DNA, 1714 bp, Homo sapiens
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttctggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagcc

SEQ ID NO: 4474 - DNA, 1236 bp, Homo sapiens
atggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagcca

SEQ ID NO: 4475 - DNA, 1742 bp, Homo sapiens
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaa

SEQ ID NO: 4476 - DNA, 2339 bp, Homo sapiens
gtgtgtgtgatgtggggagctcgggggcgggtcgggccgggcctccggcagactgcacggcccggatttgggtttctcattttgcagcgggaggtctgggaagacaacgggaggaggcggggccgggtctccggaaggaggcggggcaggggtcgggtcgagtctttgttggggcgaagaagctggagggtgggccgctgggggcgaggtggttggtccccggtttgggggaaaggggacttttttctttttagagtatcttgaaaggcgctagtgcgcgcaggagaggtacacagatttccctccaaaaccttgttaccaggcgcactgcgattgatgccccttgcctttgcttgggcttttctcttccctcattttaagacatgaagcagctaattctggtatttcattgcgctccacttcacggagatgatagactgggctatgcatgctgaccctcgacctcctgtttgcatgtcacgcatagctcgcacttctcgagaacaaaccgcccttcttctattgaggaagaataatgaatgtctgtacgagggtcttgaaggtgcaagaactttggaggattagacgaaaatgctgcagtgcaccgaaatttcccaccacacccctgacttttgaagtcttgtgtttctctcccaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 4477 - DNA, 1840 bp, Homo sapiens
ggctcccgcgaggggaaggggagggaagcagcgcgcactcgcgcgtgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 4478 - DNA, 2716 bp, Homo sapiens
actgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagttagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaa

SEQ ID NO: 4479 - DNA, 3188 bp, Homo sapiens
aagcgtgaggtactgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaatgggtgtcctgtgtctctttattcttgggtgggtaggtgggtcaagcatgtctgagccagt

SEQ ID NO: 4480 - DNA, 569 bp, Homo sapiens
attttgtgtagccgccgaaccttgttggaggttctggggcgcagaaccgctactgctgcttcggtctctccttggggtaagtgcggcggctgtctgtaacgacgaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtg

SEQ ID NO: 4481 - DNA, 2944 bp, Homo sapiens
ggtacaaaatgcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 4482 - DNA, 2949 bp, Homo sapiens
ggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagaatgataaatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 4483 - DNA, 427 bp, Homo sapiens
cttgtctcctagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtcctt

SEQ ID NO: 4484 - DNA, 582 bp, Homo sapiens
acgttattaatgtagtagatttcagtcagctcagtatcccagcttctacgaggttttacatttttcatcagaagtgtttgaatttcatgttgctccttgtattaatgaagacacttggattaatgttttaacggtcaactatcccacggagttgctttgatacaaaaccaaggagctgattgtagctctgccctttttgctttgtaattctaagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggcctt

SEQ ID NO: 4485 - DNA, 2017 bp, Homo sapiens
aatggtttcagatcaggagaaagagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 4486 - DNA, 2870 bp, Homo sapiens
ggtacaaaatgcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 4487 - DNA, 2324 bp, Homo sapiens
agcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 4488 - DNA, 2260 bp, Homo sapiens
gaaggcaagtcccctgcgcgcggggcacggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 4489 - DNA, 1886 bp, Homo sapiens
cggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaaga

SEQ ID NO: 4490 - DNA, 4010 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 4491 - DNA, 591 bp, Homo sapiens
ttcatctcccagcgggccgagcgctgaaggcagcggcgcggcgcctttgtggtagcagtggccccgcgcggaggaagttccggtgtccgcggcgctgggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttcta

SEQ ID NO: 4492 - DNA, 582 bp, Homo sapiens
agtagattaccggtcccgccgcggagcggccagctgtgaggctggggccggcgcgtggttgcggctctgtgctcctactcttcggagctgtaagcgggctgttcttgcggttttcctgtttcagatccaattctgtggcatcactaggaagggagctcttgtgcttagcacgtagcctcgtcctcagacttggacagacacaagggaggctccgctggaccggagggcacaagagctccgagcccggtcgtcggggcggtagaacctggaagcgggagagtggtctggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggag

SEQ ID NO: 4493 - DNA, 2128 bp, Homo sapiens
agctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 4494 - DNA, 3748 bp, Homo sapiens
acggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtgat

SEQ ID NO: 4495 - DNA, 4243 bp, Homo sapiens
agatcgggttcaacggcagggattgggtaaggtgagaatctggcttggcggctccggccccggccatctggttcccttgggctccggccgccaccatccactcgacggctctcggcccgaacgcttggtcgcaccgcctgccgaggtcctagatgaatcgcttcaggcctggaaacgaggaagccgtctccggagaccatcgccaacgctgacgcccgcggtctgaggtcgccatgggaagagcggtaggccaccctgctcctctgatcaccggaggacagggacacattgttcagggccatattcaaacactgcccgcagtacttgcgttacgtccctttgtgaaggcaggcccttcgcggctccccagatcagtccagcctgtgtcggacccgatgactaagcacacaggaacccataactgagcctgcggaagagccagaagccgccttgcctttaacgaggggtatcctggcgagcatgcgcagaccgtccgcgcacgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctga

SEQ ID NO: 4496 - DNA, 796 bp, Homo sapiens
gagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttct

SEQ ID NO: 4497 - DNA, 2827 bp, Homo sapiens
ccctctgcgacagtttcccgaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgct

SEQ ID NO: 4498 - DNA, 1948 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatact

SEQ ID NO: 4499 - DNA, 2012 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 4500 - DNA, 671 bp, Homo sapiens
gatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaag

SEQ ID NO: 4501 - DNA, 2052 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatgg

SEQ ID NO: 4502 - DNA, 1528 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 4503 - DNA, 798 bp, Homo sapiens
cctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtag

SEQ ID NO: 4504 - DNA, 1523 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 4505 - DNA, 5084 bp, Homo sapiens
gtggcccccaccccttccctcctccatttccatccattccgcgatcgcggcggaccccaccgtcatcgcgcgccgtgagtcacactccacagccaatccctggccacatccgggctcgcccccgccccgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctgaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaag

SEQ ID NO: 4506 - DNA, 4799 bp, Homo sapiens
cacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggataggaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagaca

SEQ ID NO: 4507 - DNA, 2215 bp, Homo sapiens
aacagccgaccaatcacaggcagcaggggcgcgccctgcagcggggctccggctgcggttccgtggactcggcgactaggcgccgcctgaccagtaggagccgccctcgacgagcgagctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacacggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatctatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttc

SEQ ID NO: 4508 - DNA, 3469 bp, Homo sapiens
atcacttcccacttcctctgacccaccattcggcagggagacatgatggaagcggatcgcccagagaagcttttcattgggggcctcaacctcaaaaccgacgagaaagccctcaaagccgagtttggcaagtatggccacatcatcaaggtgttcctgatgaaagaccgaaaaaccaacaagtcgaggggcttcgcgttcgtcaccttcgaaagccctgcagacgccaaggctgccgccagagatatgaacggcaagtacctggatggtaaggccatcatggtggcccagaccatcaaaccggcattcaagagcagccgatgggtcccgccaacccccggcagcggcagtcgctcaaggttctcacacagaacccgtgggggtggcagcagcccacagcgacccccctctcagggcaggcctgatgacggccgcggctacgcggggtatttcgacctgtggccctacagggccccgatgcccaggaagcgcgggccgccaccgcggcactgggccagcccaccccacaagagggccacgccgtcgagcctggctcacagcgttggctgtggaatgcgcgggaaggcaccgactgtgtcggggcaagatggctactcaggcttgcagccacggcgctgggccggcccaccccacaagagggctgtgccccggtcaagcctggctcgcattggcggcagtggaatgcctgggaaggccccggccgtgtgggggcaagatggctactcaggcccgcgggtccgggagccactgcccccgtgccgcgaccctggggattttgtccctgcgctcagagactacagccgccgctattatggccactccagtgtcccggactaccgtcccttgagaggcgacggcaaccaaaatggctacaggggtcgcgaccatgagtacacagatcatcccagcaaaggctcctaccgagagcccctcaagagctacggaggcccatgcggcgctgcccctgtgtgggggacaccgccatcttatggaggaggatgccgctacgaggagtaccagggcaactcgcccgatgcctgcagtgaaggccgctcgtccgaggccttgccagtcgtcttgccagacgcctacagcagggaccactcgcccaaagcctatagtgggggccgcagcagttccagtaacggttacagccggagtgaccgctacggagaagaaggctgctacgaggagtacagaggccgctcgcccgacgcccacagcgggggccgcaacagttccagcaacagttacggccagagccaccactatggaggagaaggccgctatgaggagtaccgaggccgctcacacgaggcccgcagcgggggccgctccactgatgcccacagcaggggccggtccgacgacgcctacagtgggggccatgacagttccagctggagcgactgctgcggaggaggaggccgttatgaggagtaccaaggccgctcgctggatgccaacagtggaggctgctcgcccgaggcctacagtgggggccacgacaattccagctggagcgaccgctacggagtaggaggccactatgaggagaaccgaggccactctctggatgccaacagcggaggccgttcacccgacacccacagtgggggccacagcagttccagcaacagttacggccagagccaccgctatggaggagaaggccgctatgagtaccgaggccgctcgcatgacgcccacagtgggggctgctctgccgacgcctacagtgggggccacgacagttccagccagagcaaccgctacggaggaggaggctgctacgaggagtaccgaggccgctccctcgatgccaacagtggaggccgctcgcccaatgcctacagcgggggccacgacagttccagctggagccaccgctacggaggaggaggccgctacgaggagtaccgaggccgctcccttgatgccaacagtggaggccgctcgcctgatgcctacagtgggggccacgacagttctggccagagcaactgctacggaggaggaggccgctacgaggagtaccgaggccgcttgctcgatgccaacagtggaggccgctcgcctgatgcctacagtgggggccacgacagttccagccagagcaaccgctatggaggaggcggccgctacgaggagtaccgaggccactcgcttgatgccaacagcggaggccgctcgcctgacacctacagccggggccacgacagttccagccagagcgaccactatggaggaggaggtcgctcactcgatgccaacagcagtggccgcttgcctgacgcctacagtgggggccatgacagttccagccggagccaccgctacggaggaggaggccgctacgaggagtaccgaggccgctcgctcgatgccaacagcggaggccgctcacccaatgcctacagcgggggccacaacagttccagccggaacgacccctgcagaggaggaggccgctacgaggagaaccgaggtcactctctcgatgccaacagcggaggccactcacccaacgcctacagtgggggccgtgacagttccagcaacagttacgaccggagccaccgctatggaggaggaggccactacgaagagtaccgaggccgctcgcacgacacccacagcaggggccgatcgcccgatgcccacagcggggaccactacaccgaagcctacagcaggggccgcgacagtttcagcaacagctatggccggagtgaccattacggaagaggaggctgctacgaggaataccaaggccgctcgcccaatgcctacggcgggggccgcggcctcaacagttccaacaacagtcatggccggagccaccgctacggaggaggaggccgctacgaggagtaccgaggcccctcgcctgacgcccacagtgggggccgcgacagttccatcaagagttacggcctgagcgaccgctacggaggaggaggccactacgaggagtaccagggcagcttgcctgacgcctacagcggcgaccacgacagatccagcaacagttacggccggagcgaccgctactcgaggggtcgagaccgggtaggcagaccggatcgtgggctccctctgcccatggaaacgggcagccctcccctgcatgattcttacagccggtcaggctgcagggtgcccaggggcggaggccgtcaaggaggccgcttcgagaggggggaaggccggagcagatactaagcaggaacagacttgggcccaaaaattccttttcaaagaaacaaaaagaagaacctgttctatgttaactacccaaggactagtataagtaggagttgtttttaccttttaagaatttcctgttaagatctccatttttatgcttttgtgaggaaaaacttaaaattagtttgaaattgttaatgtttctttcaacaagttcttgttaaaagtataagatatg

SEQ ID NO: 4509 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4510 - DNA, 1885 bp, Homo sapiens
cagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgc

SEQ ID NO: 4511 - DNA, 1767 bp, Homo sapiens
atggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgc

SEQ ID NO: 4512 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4513 - DNA, 1491 bp, Homo sapiens
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgc

SEQ ID NO: 4514 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4515 - DNA, 1769 bp, Homo sapiens
atggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4516 - DNA, 1491 bp, Homo sapiens
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgc

SEQ ID NO: 4517 - DNA, 1921 bp, Homo sapiens
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4518 - DNA, 1881 bp, Homo sapiens
agctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 4519 - DNA, 1887 bp, Homo sapiens
cagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 4520 - DNA, 1810 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 4521 - DNA, 1921 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 4522 - DNA, 1886 bp, Homo sapiens
cagggtagctccagctgtccctcccgcagttggccctgtggtgttccgaagccggttacgtacgcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 4523 - DNA, 1810 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 4524 - DNA, 4273 bp, Homo sapiens
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 4525 - DNA, 583 bp, Homo sapiens
atttgccttctcttcacttggggagtatcaatttgccacagagcaagcaacagcgggtggtcctaggagacttctgtgtggtctagggagaccttgacacagtcgcctaagaatggaccgtgtttacagcctctaagaatggactgtgtttagaatgaggggcagcctgaaaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgct

SEQ ID NO: 4526 - DNA, 1550 bp, Homo sapiens
ggaaggattacactgttccaggttttagggagaaaggtttaccaaaccggtggccttaaatgattttcgctccttgatattatcatcttgaaggaaagctgcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 4527 - DNA, 1815 bp, Homo sapiens
ggccgcggtaggtggggacgcggcggcgctgctcctccgctgccgccgggagagtcggcgacgccgccagctccgcgcgcgaactcccgtccatggcacgcagggcggcggctgcccgagctgctcgagtctcgcccgctgccgcgccgtacttttaggcgagtgcggaggtcgaaggcggaggggaagtcagcgcggagctgcagcccccgccggccgccgccgcgcggcgagagggagttcccagagctgccgcggccccgggcccggccggccacctccttgcgccctccccctcgcggcgaggctgccccgcgcccgcgcccgcgcccgcacccgccgccgccgcccgcagcgatgatcttccccagcagcagtggcaaccccgggggcagcagcaactgccggacgccctatcgcaagcagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaa

SEQ ID NO: 4528 - DNA, 1702 bp, Homo sapiens
ctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgc

SEQ ID NO: 4529 - DNA, 1490 bp, Homo sapiens
atttgccttctcttcacttggggagtatcaatttgccacagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 4530 - DNA, 3147 bp, Homo sapiens
ccctcgctcccctcctccctccctccccgtctttcttaccccctccctttctctctctctctctctctcgctcgttccctaacattaaagagaaaatgctgctatccgtgacttccaggcccgggatttcgacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtccagagcaacctgccctgccccggtgtgcttggaccctttgcccagggaaccaggacatcagaaataatgttccttctgtggaaggacaacggggagctagggtagcaaagagcaataaattccaactctttatgaggtca

SEQ ID NO: 4531 - DNA, 3278 bp, Homo sapiens
acgctgctccctggagaggctctctcggttccacccaccggctggaaggaggggaagtgaatgaaaggacaggacaagccccgaacaccatgtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 4532 - DNA, 1864 bp, Homo sapiens
atcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgcca

SEQ ID NO: 4533 - DNA, 2757 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccagggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 4534 - DNA, 1394 bp, Homo sapiens
agctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcc

SEQ ID NO: 4535 - DNA, 8208 bp, Homo sapiens
tttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgacatggccggaccagttctttctttgttgtttgtttaaactaccttccactggtgttttacatagtgcaaaaaaaaaaagagggtggggggagttgtctctcttttctttaaatgtgtattcattgatagcagaagcttgtacctgctgtgtttagcagtttcagcatgaagagttctggatatgaactgattcatagagccaagtggctttaaattctgtgagcttttctggtttctcactagctgtcttgaatagtgaaacctgtattgatggccactagtaaaccaagatgcttatttaacaggtggaatattctttatatgaaatttcagctaaagacactttctggacctggtctgaaaggtcatttgtcaaaaaagcttagggatattctgtgaaatggtgagtggtctcctggaaaggtctcattgtatttgaacaatagtcttccctctaaattacaacacctctgggttttgtctttacacctctgtctttgtcatcacctaccatgaatagtcaccttggttttgcaaatggggagggggtatcatctttttgcctgttttcactgtatttttgtatattggtgttgccgaaagaactttttctttcagtttaattctttgaggcatgtaggaccaataagattgagaattctattggtggaatttagggaagtccttaaaatgctagttgacaatcaaggaacagtatgatttatatcaataagaaccaaaagaattaggtttgatcaatcatttaagccaaggaggaatacttgcatttagaacaatgcaaaactttgtctaaaatgaattaaattgacccacctgtaaaatatatctacatttttaattcatgagatgatatgtgttcaacctttacagttttacctgaaattaaggacaatggaatagaatttgttaagtgaaccattcactagattgctttctgaatgaatcctttgaatcaaataggtgaaactcttttcaaaaactaagtcagtcacaggagcctgtcttagtccaaaagaagcagggaaatgtatttaagtgtactataaaacagggtaggctttttaaaaactaaaaagttttaaaggtaaatcatattcccattaggtcaacatgagtaataaggttgactcatgtgaaattgtcaatattctactatttctgtaaactctggttctcttatttgcaaccccatgcactggaagcccaaatcagagaatgactccatatatttatggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaagaaaaaaaatagaaggaaaacaacggcacatactcaaatttgccctgctttgtctgttgtcttacctaagacttgttttgaagagccaagtctgggagagaaaaaaaagcatcaacaggtaagcagcattacattgtgtggtaataaaccaaaataagttttcaatatatacagacaacagaattcaaatttaatcaacaaaatatattgtagtgatttgtttgtttgtttgtttgagacggagtctcgctctgtcgcccatcctaactaggactataatctttttttttttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattgaatagg

SEQ ID NO: 4536 - DNA, 1598 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaactta

SEQ ID NO: 4537 - DNA, 2207 bp, Homo sapiens
ccgcgccggaggacgagcctcggtcatcgcgctgccctcccaggttcaacaggctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatcta

SEQ ID NO: 4538 - DNA, 1271 bp, Homo sapiens
ggcgccggcctcggcggctgaggaaagcaggaggaggtggcggcggcgggaagatgacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgca

SEQ ID NO: 4539 - DNA, 2010 bp, Homo sapiens
ggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgc

SEQ ID NO: 4540 - DNA, 3110 bp, Homo sapiens
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 4541 - DNA, 2974 bp, Homo sapiens
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 4542 - DNA, 1341 bp, Homo sapiens
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactc

SEQ ID NO: 4543 - DNA, 2819 bp, Homo sapiens
ggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctat

SEQ ID NO: 4544 - DNA, 2941 bp, Homo sapiens
gggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtcacacca

SEQ ID NO: 4545 - DNA, 2008 bp, Homo sapiens
actcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaacc

SEQ ID NO: 4546 - DNA, 1789 bp, Homo sapiens
ggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctga

SEQ ID NO: 4547 - DNA, 871 bp, Homo sapiens
gcaactttcattccctctgaaataaaacagtgcttaggccagtacctagtctgtttccaactgtgcggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagcc

SEQ ID NO: 4548 - DNA, 1204 bp, Homo sapiens
ggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggttcccagagagggggcttcttgaaaagcaagtagagcagaagactggtgagcacggtgtttcccagcatctccacagtgccagcacagaggaggacactcaagaaatgtttgttaagtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaag

SEQ ID NO: 4549 - DNA, 766 bp, Homo sapiens
gcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactgtcttcatttccctatttgtaaagttggagtgcctccctgtcccctcacgtctcatgtgtgtactcctaccatgcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatgg

SEQ ID NO: 4550 - DNA, 1817 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctga

SEQ ID NO: 4551 - DNA, 3268 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 4552 - DNA, 2277 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaa

SEQ ID NO: 4553 - DNA, 3321 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 4554 - DNA, 2196 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaa

SEQ ID NO: 4555 - DNA, 1530 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 4556 - DNA, 4021 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 4557 - DNA, 4099 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 4558 - DNA, 1513 bp, Homo sapiens
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 4559 - DNA, 3524 bp, Homo sapiens
aagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaa

SEQ ID NO: 4560 - DNA, 974 bp, Homo sapiens
gcggcgtgtgcgcctccggggctgctgattagaataggggacttggccgtggatggaatccgggaaacccaaaccggagatggaaggatgaggctgcgtttgcagcgcgtgaatgggacgcggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 4561 - DNA, 1354 bp, Homo sapiens
ggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttt

SEQ ID NO: 4562 - DNA, 759 bp, Homo sapiens
gagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagctggaaggctgaagtctttcacctgagctgctgccagttcgctcttctgttcctgggtggttgggagaagagaagagggagggtattttatgctttaattaaagacagataagagagcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggtttggcaaaatcctagatgtagaaataatctttaatgaacgtggctct

SEQ ID NO: 4563 - DNA, 6661 bp, Homo sapiens
atgaagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacc

SEQ ID NO: 4564 - DNA, 663 bp, Homo sapiens
atggtagctgtgtgcaaggggagagcagcagggtttagaattccaggaaggaagagagagtgatgtcatcagattccatggaccagcccaggaacccctgtgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggcc

SEQ ID NO: 4565 - DNA, 1356 bp, Homo sapiens
atggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactga

SEQ ID NO: 4566 - DNA, 1409 bp, Homo sapiens
aacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaa

SEQ ID NO: 4567 - DNA, 1538 bp, Homo sapiens
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaa

SEQ ID NO: 4568 - DNA, 6932 bp, Homo sapiens
attctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacca

SEQ ID NO: 4569 - DNA, 1935 bp, Homo sapiens
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 4570 - DNA, 1706 bp, Homo sapiens
atggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 4571 - DNA, 1254 bp, Homo sapiens
agaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctatt

SEQ ID NO: 4572 - DNA, 2678 bp, Homo sapiens
caaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaagatgttaagatccaagcaacaaaaaaaaaaccaaccaaaccaagaggcatccaaccaagtccaagtcccgcgtcctggccacacgcccgcaccgagggagcacgccggcaggggcgccgaggagcggccccaggacaggacggccccaccgcgtcctggctggcagcacagtgggaacacgcccctccgtctcaggcagtgggggagttggaggggaaggggcctcccttgtgggacccgtggggggctctgttttccatccagtcttcctttcccagcccccaactcccaagacagacagtgtggagcccagcggcggcggagcaggcccgggcctgagcaggcaggcgctgctagcaagacttgatctttgtggccagctgtgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggcccggggcctgtgtacaccaaggctgacctcgtgctgcctgctgggacccagccctccctgccgctcccctgtgagcccagtccaccgtgggcgcccagggccagggacgggccagcgcccggctgcatcgcgaggttgggagtcacagtggctgtgggcctggacgggcacagccagagcaggggcccatgggaagggcaagggatggggaagcctgggccggccccttccctgctcccaaggcaggtgtccaggtggcgggagcagcaccaaggacagccaggcttacccggtgggaggagcaggagcagagcaggtggcagggaggaacccctggcgaggcagggagcactgaagtagggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagg

SEQ ID NO: 4573 - DNA, 1519 bp, Homo sapiens
gatacagcagcagctggtgctcctggccaggctgtgcgtgctctctctgcctctctctctcggactctctgctctctctctctgactctctcctctctctctgttggcctggtgaaatgttcttggctgtaggcacacagagccttggactcaaggctgttggagtcgaggacaccttgacttcggtcctggaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaac

SEQ ID NO: 4574 - DNA, 3681 bp, Homo sapiens
gggaaccggaaggtgcggtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacgggctgttgcaaagaaagttcatagtacaatccagaaaattaagaaggaagggaagatgtctgagtgcttgttaaaagccatgctgaattgtaaaacttttgaagaactagaacacgtgtctgctccatataaaactggaagcaaagggactaaagcccagagagcaagacagttgggcttagaaggagcagccagggcactgcttgagaaaccaggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 4575 - DNA, 1980 bp, Homo sapiens
agtttctgtcccaagctttattatttctgttaccttattcccttctccaccatgggtcttcctgtgtgtcaggattttttattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattc

SEQ ID NO: 4576 - DNA, 3482 bp, Homo sapiens
atcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcat

SEQ ID NO: 4577 - DNA, 2103 bp, Homo sapiens
tctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcac

SEQ ID NO: 4578 - DNA, 6676 bp, Homo sapiens
gaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttgggttatttggcctaagctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgggggtgtgtgtgtgtgtgtgtgtgtgtgtgtgtgtgtccgtgtccctgagttaagaatggtttttaggcttgtataggattaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatagcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatctttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaa

SEQ ID NO: 4579 - DNA, 1621 bp, Homo sapiens
gctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtt

SEQ ID NO: 4580 - DNA, 1077 bp, Homo sapiens
ccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 4581 - DNA, 2751 bp, Homo sapiens
gcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaagtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagctttacagttcaccattaactgtagaactataaaatgatttctgaagtgtcaagataaatgttaattctgaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaa

SEQ ID NO: 4582 - DNA, 3335 bp, Homo sapiens
gcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatc

SEQ ID NO: 4583 - DNA, 832 bp, Homo sapiens
gctttgtcacgctggctggagtacagtggcgcaatctcggctcactgcaatctccgcctcccaggttcaagcaattctgcctcggcttcctgagtagctgggactacaggtgcgcaccaccatgcctggctaatttttgtatttttagtagcgtcggggtttcaccatgttggccaggctggtctcgaactcctgacctcaggtgatccacccgccttggctcctaaagtgctggaattacaggtatgagccactgtgactggccgcaggtggtctgattctagtcctggctctgtcgcagactagctgcttgatctcaggaaatgtctctatttctagattgtcttcaatgttcttatcctgcttatctgtggataatattcttgatagtcatgtgaaggatctatcttgggaaagccaaggacatctgggaatgtttgacaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaa

SEQ ID NO: 4584 - DNA, 6290 bp, Homo sapiens
ccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcaccctctcttgttcttgtggccttcttcactctgtaagatattgtgttcactccctggcttttttcatgcagatagaagattagtgattttgctgggattcattgaagggtctcctttcctcttcaattacatcagaatctaaagcagcaacagggtccccataaaaacttgctcttcgattgtcccagttcttgttgagtgctgctgtgaaaagtgacaggtttcagccatgggtcagcatttctttttaagacacctgatgatgctggtggaaatggatcagtgggtaacattgtgctgttctgtaaagggtgcagacctaagtcctccacttgcattctcaccttgtttggaaagccaatgatgttactaggtcaatggtttcattaaggtactcacccccatgaaggagcagcagtgtggtcccctgtcaatatttataaggcaccatgtcttaaaaatgtctgtttttagtatgaattagctttcattttccctattcagttctgcttttgggaacttgacagggcccatccatgagaatgggcttcacaaaatatggcaaatgtatgtaccaaattccttcgggaccactaaataaaggtgaaatgggcaatgtacaacaaatgttagtgtcacttctcagatatatattacacaatgattagtttgtttcttctccttggtcttttgtctttattagtggtgggtgatactttaataaaacctcatcacttgctggaaatagctgtaacttatcattctcatcctgtgcattagtggctagacataaacaagagggcccatttcagctgggagttttcatgtttcattgatgcgttttgctgacctatggatgaaacagagccatcactgagaagaaaaagcatggctgatagtgtccagtttttattaattaaatctttacagtagtcctcattgtctttggaatactattaattggcagctgcggctgtattgttatttgaaattggtcatcaaatttggattccacgttggaatctctagatatttctcgttagaaaattcttttgaagtagctgactctgcttcataactcacgcgctctgtaatggtgaaaagggagctgtgctgttttccaacatgatggcagtcatttcaaatggtttctaccaagtcttttttttttttttttaattttgttgtttgttggaagttactaaccatgttgtaaacctgcccagttgctgcaaacttttacatttctctgctttacttaaaataatcgagctgtcagtcctttgttagaagtggtaaccatgcaagttcaactgtttaaattctgtaatgaattaagtgtccccccacctgttgcccttcccacccttccattttgtaatgaaaattccacttacagctgaaagagcagagaaatataaatgaagctcttggcttcaccaaattgcctgagattaacatgaagttttgcttctctgctcttttctccactgtaggtggttttttcattgacagcccctattgccagcctctgagcgtcgcaccatttattattcacttgggccctcaagatttcttctctgacttctagaaccatcaggttgtctggcttgaaatggcaatttctatgtcttggtcttaagagcaatgtgacaccctgaggctatccagctttcagacactccactctgacaccctctttttgaaagcaatgactgatcattttaaagaagagcaatactttgttcaaagccacggtgtctgttttaaaacttttcctttggaaacctagcaatatctgtacttaacccctttttagcatagtttcttgtcagggagtttacaggtcagtgtagagcttaaaattagcgtgtgagctgtgctatgttctgacagttttttacactttttagcacataaatagttacattcctgactgcgtcagttagcgttactataatttctcagagataggggtcctccttgaagccatatcctctgcacggggactggcccctagccagggatgtggcttgcagcttgtgtttcttcaggctgcaggagtaccccatctcttgtgcaaggtaattggtccagtagatttccaacatacctcatgctgactagatgaagtgcatgggtggtgaagtaaggagttgagtttatatagttctgaagtcgtttgtagtctctctcaaattgttagcctggggaacaaaccactgagagattttgctggtattggccttttctttttttttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatg

SEQ ID NO: 4585 - DNA, 2990 bp, Homo sapiens
ccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgataaacaagaacaaaagaggcaagactgttcataaaaaattgagaatgttttagtttgcgatggacttcaaaacaaaatatttaccatgtactaacatataatttcatagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaa

SEQ ID NO: 4586 - DNA, 408 bp, Homo sapiens
ggggccgcgacctcggctcgagaaggtgctttagtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 4587 - DNA, 3500 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4588 - DNA, 3211 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4589 - DNA, 3534 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 4590 - DNA, 3332 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagacggagtctcgctcttttgccaggctggagtgcagtggcgcgatcctgagtcactgcaacctccacctcccaggttcaagcgattctcctgcttcagcctgccaagtagctgggactacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4591 - DNA, 3154 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4592 - DNA, 643 bp, Homo sapiens
ttaaccacttaacctctcagaactgaacaaagacaacattgttcctggaacgccctctttttaaaaaagctttttccccttcagcatttatccatgagacaatcaccaagatgacccagggattgtactgcgttgcaggcttctgccatttgaccttcctgcctgccagggttttgagttcatgctgttgtttgtacttaaatgagtagcctgatggactgcagaacatataataaaggagacccctgatgtcctgatgtgtgaagtgtcaagggggtggaagccgtgcactgagggaatcctaaaagtaagacctacaagaaaaatcagctatgaaggcaacataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggag

SEQ ID NO: 4593 - DNA, 3136 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4594 - DNA, 3516 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 4595 - DNA, 3130 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 4596 - DNA, 1083 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagacggagtctcgctcttttgccaggctggagtgcagtggcgcgatcctgagtcactgcaacctccacctcccaggttcaagcgattctcctgcttcagcctgccaagtagctgggactacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaag

SEQ ID NO: 4597 - DNA, 4061 bp, Homo sapiens
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 4598 - DNA, 3065 bp, Homo sapiens
agggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtg

SEQ ID NO: 4599 - DNA, 2173 bp, Homo sapiens
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaaccgatattattgtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttccaaaatgagaaga

SEQ ID NO: 4600 - DNA, 2646 bp, Homo sapiens
agcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtgaa

SEQ ID NO: 4601 - DNA, 2173 bp, Homo sapiens
actcttgcctcataaatctaggattcagggcattgttttcaatggttctcatttttggctccaaggattctttttcatgtgactaatattttcggtagaagaggaggtctggccacgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactca

SEQ ID NO: 4602 - DNA, 550 bp, Homo sapiens
agttctctgtagtgtttgccaatgttggagccgtctgcaaagtgtccccggcaagaagagacgattttgccgtgttcgccaggctagtctcgaactcctgacctcaggtgatccgtccgcctcagactccaaaagtgctgggattacaggcgtgagccaccacacccagctgaggaggtggattttatgaaaccaaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactcc

SEQ ID NO: 4603 - DNA, 727 bp, Homo sapiens
agcggggtcagttctctgtagtgtttgccaatgttggagccgtctgcaaagtgtccccggcaagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatg

SEQ ID NO: 4604 - DNA, 5130 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaa

SEQ ID NO: 4605 - DNA, 1368 bp, Homo sapiens
gctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtgga

SEQ ID NO: 4606 - DNA, 1867 bp, Homo sapiens
tccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaa

SEQ ID NO: 4607 - DNA, 4647 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 4608 - DNA, 4770 bp, Homo sapiens
gctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 4609 - DNA, 4633 bp, Homo sapiens
aactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 4610 - DNA, 515 bp, Homo sapiens
aaaaaagaaagaaagaaagaaagaaagaaaagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattg

SEQ ID NO: 4611 - DNA, 1401 bp, Homo sapiens
accctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaa

SEQ ID NO: 4612 - DNA, 490 bp, Homo sapiens
ttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtct

SEQ ID NO: 4613 - DNA, 2187 bp, Homo sapiens
ttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaa

SEQ ID NO: 4614 - DNA, 2317 bp, Homo sapiens
tcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaag

SEQ ID NO: 4615 - DNA, 1827 bp, Homo sapiens
gcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtctttaaatatgggtgttttgtcatcatatttcttgtagctttatcccaatctggataaattgtaaatacctataaaataaattataaatacctataaaatataaagtaacatagctctaaaaggcttaaaatcaaacacaggtgttatttgtctgccctacccatagcaccaaattccattccctagaagaaactacttacatgtgcacacatgtagctaaataaagtacatatatttcagtcacttaataaaagaataaaggagaattattcaatctcttatacttctcctaccttcctcaatattcccaatgtggctgtattaaaaatttgggggaatccatatatatcttttttaataaccaagtaaatacttttcatttctgagccaaggaatatgctatgattacgttttttcctagagttaataattgtctattttttttccatgtattgtctttgtatttatgactaaatcttcccattctgtctgcaggtgggtatatggtaatgggattagagagcctttaattttctgctttgtatatttctatattgtttaactttgtaagaatgcccattacttttttaactagtaaaagcaatagaaataagttaatactatcatagtaatattattattgtcatcccaagaaaaaatatattaaaaagatatttgaaatttcattataaaa

SEQ ID NO: 4616 - DNA, 4738 bp, Homo sapiens
agtgcggtcggaggcggcggtctgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 4617 - DNA, 650 bp, Homo sapiens
gttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccagcagcaacagaagcaggcagcagcagcagctgctgctgctgctgcaacagctgcctggacagggaccacctttactaa

SEQ ID NO: 4618 - DNA, 3317 bp, Homo sapiens
gttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccagcaagctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggaatggatttgaagctgaggggaaaaaagacaaaaaagattatgataacttttaaaaagtgtctgtaa

SEQ ID NO: 4619 - DNA, 866 bp, Homo sapiens
gaagacgccaagatggcgacgagtcagtatttcgacttcgcgcagggcggcggcccgcagtacagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccaggagagccacccagctgagccccatctggccaggagagccatccagctgagccccacctctgccaggattgccacccagctgagccccgccttggccaggagagccacccagctgagccccgcctgggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttgg

SEQ ID NO: 4620 - DNA, 4757 bp, Homo sapiens
gaagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaaggtcttcaagctgcacgccaaactggggaagcccattcccaccctcgagcctgcactggccacagagagcccccccggggcagaggccaagcccacgtcccccactggccccagcgtgtgtgcctcgagcaggccagcgctggccaagagacccgtggcctcgaaggccttatgcgaggggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcggaaggtcctggaggagcgcatgaggaagcagcggcacctggcggaggagcggctggagcagctgcggcgctggcacgcggagaggaggcggctggaggaggagccaccccaggacgtgccgccccacgcgccgcccgactgggcccagcctctgctcatgggcaggccggagtcacccgccagcgccccactccagcccgggcggcggccggcgtccagcgacgaccggcacgtcatgtgcaagcacgccaccatctaccccacggagcaggagctcctggccgtgcagagggccgtgtcccacgcagagcgggccctcaagctggtgtccgacacactggccgaggaggaccggggccgccgagaggaagagggtgacaagcgcagcagcgttgccccccagactcgggtcctgaaaggcgtcatgcgagtaggcatcctggcgaaaggcctcctcctgcgtggggacaggaacgtgcgcctcgctctgctctgctccgagaagcccacgcacagcctgctgcggaggatcgcccagcagctgccccggcagctccagatggtgaccgaggatgagtatgaggtctcctccgaccctgaagccaacattgtcatctcctcctgtgaggagcccaggatgcaggtcaccatatctgtcacctcacctctgatgcgggaggacccctccacagacccaggtgtggaggagcctcaggctgatgcaggtgatgtcctgagccccaagaagtgcctcgagtccctggccgccctccgtcatgccaggtggtttcaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagaccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccacagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggggacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtc

SEQ ID NO: 4621 - DNA, 1377 bp, Homo sapiens
aagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaagggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcg

SEQ ID NO: 4622 - DNA, 3228 bp, Homo sapiens
gggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctg

SEQ ID NO: 4623 - DNA, 4006 bp, Homo sapiens
ctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagca

SEQ ID NO: 4624 - DNA, 4076 bp, Homo sapiens
gcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacact

SEQ ID NO: 4625 - DNA, 3774 bp, Homo sapiens
gagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaa

SEQ ID NO: 4626 - DNA, 4167 bp, Homo sapiens
cagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacacta

SEQ ID NO: 4627 - DNA, 626 bp, Homo sapiens
attggatgaatcatctctttgctcttatttcaaccttttaattactgatccaccctctttgattacctgacacaacaggaatatctttcgtaacttgaaagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaa

SEQ ID NO: 4628 - DNA, 503 bp, Homo sapiens
attcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatatgtatatattctttttctttttaaaacagatgagctttgatccaaacctt

SEQ ID NO: 4629 - DNA, 3459 bp, Homo sapiens
gcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaa

SEQ ID NO: 4630 - DNA, 601 bp, Homo sapiens
agatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcct

SEQ ID NO: 4631 - DNA, 2667 bp, Homo sapiens
tacgtaccgggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctg

SEQ ID NO: 4632 - protein, 255 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGVTSSTEVLNPSKSSMKIGIIIFQTPVNIDILASSHES

SEQ ID NO: 4633 - protein, 310 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 4634 - protein, 339 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 4635 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 4636 - protein, 244 aa, Homo sapiens
MSSRWSRSSQSTDRSLKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 4637 - protein, 263 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 4638 - protein, 153 aa, Homo sapiens
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 4639 - protein, 303 aa, Homo sapiens
MSEEQFGGDGAAAAATAAASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 4640 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 4641 - protein, 201 aa, Homo sapiens
MDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 4642 - protein, 155 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKA

SEQ ID NO: 4643 - protein, 221 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNK

SEQ ID NO: 4644 - protein, 306 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 4645 - protein, 210 aa, Homo sapiens
  misc_feature (1)..(1): Xaa can be any naturally occurring amino acid
XKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 4646 - protein, 336 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 4647 - protein, 281 aa, Homo sapiens
MSEEQFGGDGAAGNGGGRRAGEQEGAMVAATQGAAAREAEPGPGAEPRLEAPKGAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 4648 - protein, 577 aa, Homo sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 4649 - protein, 599 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 4650 - protein, 542 aa, Homo sapiens
MFSCPGHYHVDGFLNPGSRKIQIRNIPPHLQWEVLDGLLAQYGTVENVEQVFAFSLVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 4651 - protein, 556 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 4652 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 4653 - protein, 443 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4654 - protein, 404 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4655 - protein, 419 aa, Homo sapiens
MQRRDDPAARMSRSSGRSGSMDPSGAHPSVRQTPSRQPPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4656 - protein, 349 aa, Homo sapiens
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYGYDDGYGGEYDDQTYETYDNSYATQTQSVPEYYDYGHGVSEDAYDSYAPEEWATTRSSLKAPPQRSARGGYREHPYGRY

SEQ ID NO: 4657 - protein, 316 aa, Homo sapiens
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYPSLPLSLFFDTVAKSHQHCDNEVPQTGSTRLNPGRSFFLAWRWEWD

SEQ ID NO: 4658 - protein, 346 aa, Homo sapiens
MEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 4659 - protein, 341 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 4660 - protein, 325 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 4661 - protein, 319 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGKFFSPWG

SEQ ID NO: 4662 - protein, 333 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 4663 - protein, 319 aa, Homo sapiens
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 4664 - protein, 85 aa, Homo sapiens
MTGKTQTSNVTNKNDPKSINSRVFIGNLNTAIVKKVDIEAIFSKYGKIVGCSVHKGYAFVQYMSERHARAAVAGENARVIAGQPL

SEQ ID NO: 4665 - protein, 218 aa, Homo sapiens
MTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 4666 - protein, 291 aa, Homo sapiens
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 4667 - protein, 291 aa, Homo sapiens; identical to SEQ ID NO: 4666

SEQ ID NO: 4668 - protein, 85 aa, Homo sapiens; identical to SEQ ID NO: 4664

SEQ ID NO: 4669 - protein, 291 aa, Homo sapiens; identical to SEQ ID NO: 4666

SEQ ID NO: 4670 - protein, 387 aa, Homo sapiens
MVPKGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 4671 - protein, 350 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 4672 - protein, 334 aa, Homo sapiens [sequence omitted]

SEQ ID NO: 4673 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 4674 - protein, 159 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAG

SEQ ID NO: 4675 - protein, 294 aa, Homo sapiens [sequence omitted]

SEQ ID NO: 4676 - protein, 294 aa, Homo sapiens [sequence omitted]

SEQ ID NO: 4677 - protein, 240 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGP

SEQ ID NO: 4678 - protein, 334 aa, Homo sapiens [sequence omitted]

SEQ ID NO: 4679 - protein, 380 aa, Homo sapiens; identical to SEQ ID NO: 4673

SEQ ID NO: 4680 - protein, 387 aa, Homo sapiens; identical to SEQ ID NO: 4670

SEQ ID NO: 4681 - protein, 159 aa, Homo sapiens; identical to SEQ ID NO: 4674

SEQ ID NO: 4682 - protein, 387 aa, Homo sapiens; identical to SEQ ID NO: 4670

SEQ ID NO: 4683 - protein, 294 aa, Homo sapiens [sequence omitted]

SEQ ID NO: 4684 - protein, 240 aa, Homo sapiens; identical to SEQ ID NO: 4677

SEQ ID NO: 4685 - protein, 380 aa, Homo sapiens; identical to SEQ ID NO: 4673

SEQ ID NO: 4686 - protein, 159 aa, Homo sapiens; identical to SEQ ID NO: 4674

SEQ ID NO: 4687 - protein, 334 aa, Homo sapiens [sequence omitted]

SEQ ID NO: 4688 - protein, 387 aa, Homo sapiens; identical to SEQ ID NO: 4670

SEQ ID NO: 4689 - protein, 380 aa, Homo sapiens; identical to SEQ ID NO: 4673

SEQ ID NO: 4690 - protein, 334 aa, Homo sapiens [sequence omitted]

SEQ ID NO: 4691 - protein, 240 aa, Homo sapiens; identical to SEQ ID NO: 4677

SEQ ID NO: 4692 - protein, 159 aa, Homo sapiens; identical to SEQ ID NO: 4674

SEQ ID NO: 4693 - protein, 294 aa, Homo sapiens [sequence omitted]

SEQ ID NO: 4694 - protein, 334 aa, Homo sapiens [sequence omitted]

SEQ ID NO: 4695 - protein, 387 aa, Homo sapiens; identical to SEQ ID NO: 4670

SEQ ID NO: 4696 - protein, 380 aa, Homo sapiens; identical to SEQ ID NO: 4673

SEQ ID NO: 4697 - protein, 294 aa, Homo sapiens [sequence omitted]

SEQ ID NO: 4698 - protein, 240 aa, Homo sapiens; identical to SEQ ID NO: 4677

SEQ ID NO: 4699 - protein, 159 aa, Homo sapiens; identical to SEQ ID NO: 4674

SEQ ID NO: 4700 - protein, 294 aa, Homo sapiens [sequence omitted]

SEQ ID NO: 4701 - protein, 334 aa, Homo sapiens [sequence omitted]

SEQ ID NO: 4702 - protein, 380 aa, Homo sapiens; identical to SEQ ID NO: 4673

SEQ ID NO: 4703 - protein, 387 aa, Homo sapiens; identical to SEQ ID NO: 4670

SEQ ID NO: 4704 - protein, 159 aa, Homo sapiens; identical to SEQ ID NO: 4674

SEQ ID NO: 4705 - protein, 240 aa, Homo sapiens; identical to SEQ ID NO: 4677

SEQ ID NO: 4706 - protein, 169 aa, Homo sapiens
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIDTQGIISDPGSSFQMAVFIKVFGAAPKHLIL

SEQ ID NO: 4707 - protein, 157 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 4708 - protein, 157 aa, Homo sapiens; identical to SEQ ID NO: 4707

SEQ ID NO: 4709 - protein, 155 aa, Homo sapiens
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIGETWISALSEPVCHTLS

SEQ ID NO: 4710 - protein, 930 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 4711 - protein, 852 aa, Homo sapiens
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 4712 - protein, 853 aa, Homo sapiens
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 4713 - protein, 281 aa, Homo sapiens
MFPAQEEADRTVFVGNLEARVREEILYELFLQAGPLTKVTICKDREGKPKSFGFVCFKHPESVSYAIALLNGIRLYGRPINVQYRFGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 4714 - protein, 932 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 4715 - protein, 932 aa, Homo sapiens; identical to SEQ ID NO: 4714

SEQ ID NO: 4716 - protein, 932 aa, Homo sapiens; identical to SEQ ID NO: 4714

SEQ ID NO: 4717 - protein, 143 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHES

SEQ ID NO: 4718 - protein, 291 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQ

SEQ ID NO: 4719 - protein, 134 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVV

SEQ ID NO: 4720 - protein, 731 aa, Homo sapiens
MPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 4721 - protein, 143 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLR

SEQ ID NO: 4722 - protein, 1001 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPLEEDWRRPLEEDFRRSPTEDFRQLPEEDFRQPPEEDLRWLPEEDFRRPPEEDWRRPPEEDFRRPLQGEWRRPPEDDFRRPPEEDFRHSPEEDFRQSPQEHFRRPPQEHFRRPPPEHFRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 4723 - protein, 122 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGY

SEQ ID NO: 4724 - protein, 82 aa, Homo sapiens
MAVVIRLLGLPFIAGPVDIRHFFTGLTIPDGGVHIIGGEIGEAFIIFATDEDARRAISRSGGFIKDSSVELFLSSKAEMQKT

SEQ ID NO: 4725 - protein, 881 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 4726 - protein, 149 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRP

SEQ ID NO: 4727 - protein, 669 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 4728 - protein, 977 aa, Homo sapiens
MRTAGRDPVPRRSPRWRRAVPLCETSAGRRVTQLRGDDLRRPATMKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGFGFQIGVRYENKKRENLALTLL

SEQ ID NO: 4729 - protein, 890 aa, Homo sapiens
MKRQSERDSSPSGRGSSSSAKRPREREREAEAGGRRAAHKASGGAKHPVPARARDKPRGSGSGGGGHRDGRGTGDANHRASSGRSSGSGAGGGGRGGKASGDPGASGMSPRASPLPPPPPPPGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 4730 - protein, 254 aa, Homo sapiens
METVVCPPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAG

SEQ ID NO: 4731 - protein, 563 aa, Homo sapiens
MPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 4732 - protein, 211 aa, Homo sapiens [sequence omitted]

SEQ ID NO: 4733 - protein, 225 aa, Homo sapiens
  misc_feature (1)..(1): Xaa can be any naturally occurring amino acid
XPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKGVSPGKRVTRGKGLAPSISDMASLDPHVSAGGQ

SEQ ID NO: 4734 - protein, 243 aa, Homo sapiens
MGRVGRAGRSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGG

SEQ ID NO: 4735 - protein, 243 aa, Homo sapiens; identical to SEQ ID NO: 4734

SEQ ID NO: 4736 - protein, 212 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPP

SEQ ID NO: 4737 - protein, 221 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRKDRHEASGFARRPDPDSDEDEDYERERRKRSMGGAAIAPPTSLVEKDKELPRDFPYEEDSRPRSQSSKAAIPPPVYEEQDRPRS

SEQ ID NO: 4738 - protein, 401 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 4739 - protein, 401 aa, Homo sapiens; identical to SEQ ID NO: 4738

SEQ ID NO: 4740 - protein, 190 aa, Homo sapiens
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLSVTAKIKAIEAKLKMMAENPDAEYPAAPVYSYFKPPDKKRTTPYSRTAWKSRR

SEQ ID NO: 4741 - protein, 960 aa, Homo sapiens
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQERDSKGAGQEQGMPAGKKRPPEARAETEKPANQKEPTTCHTVKLRGAPFNVTEKNVMEFLAPLKPVAIRIVRNAHGNKTGYIFVDFSNEEEVKQALKCNREYMGGRYIEVFREKNVPTTKGAPKNTTKSWQGRILGENEEEEDLAESGRLFVRNLPYTSTEEDLEKLFSKYGPLSELHYPIDSLTKKPKGFAFITFMFPEHAVKAYSEVDGQVFQGRMLHVLPSTIKKEASEDASALGSSSYKKKKEAQDKANSASSHNWNTLFMGPNAVADAIAQKYNATKSQVFDHETKGSVAVRVALGETQLVQEVRRFLIDNGVSLDSFSQAAAERSKTVILVKNLPAGTLAAQLQETFGHFGSLGRVLLPEGGITAIVEFLEPLEARKAFRHLAYSKFHHVPLYLEWAPVGVFSSTAPQKKKLQDTPSEPMEKDPAEPETVPDGETPEDENPTEEGADNSSAKMEEEEEEEEEEEESLPGCTLFIKNLNFDTTEEKLKEVFSKVGTVKSCSISKKKNKAGVLLSMGFGFVEYRKPEQAQKALKQLQGHVVDGHKLEVRISERATKPAVTLARKKQVPRKQTTSKILVRNIPFQAHSREIRELFSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 4742 - protein, 960 aa, Homo sapiens; identical to SEQ ID NO: 4741

SEQ ID NO: 4743 - protein, 960 aa, Homo sapiens; identical to SEQ ID NO: 4741

SEQ ID NO: 4744 - protein, 1125 aa, Homo sapiens
MVLAAAMSQDADPSGPEQPDRVACSVPGARASPAPSGPRGMQQPPPPPQPPPPPQAGLPQIIQNAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEDYASNLGTSYVPIPARSFTQSSPTFPLASVGTTFAQRKGAGRVVHICNLPEGSCTENDVINLGLPFGKVTNYILMKSTNQAFLEMAYTEAAQAMVQYYQEKSAVINGEKLLIRMSKRYKELQLKKPGKAVAAIIQDIHSQRERDMFREADRYGPERPRSRSPVSRSLSPRSHTPSFTSCSSSHSPPGPSRADWGNGRDSWEHSPYARREEERDPAPWRDNGDDKRDRMDPWAHDRKHHPRQLDKAELDERPEGGRPHREKYPRSGSPNLPHSVSSYKSREDGYYRKEPKAKWDKYLKQQQDAPGRSRRKDEARLRESRHPHPDDSGKEDGLGPKVTRAPEGAKAKQNEKNKTKRTDRDQEGADDRKENTMAENEAGKEEQEGMEESPQSVGRQEKEAEFSDPENTRTKKEQDWESESEAEGESWYPTNMEELVTVDEVGEEEDFIVEPDIPELEEIVPIDQKDKICPETCLCVTTTLDLDLAQDFPKEGVKAVGNGAAEISLKSPRELPSASTSCPSDMDVEMPGLNLDAERKPAESETGLSLEDSDCYEKEAKGVESSDVHPAPTVQQMSSPKPAEERARQPSPFVDDCKTRGTPEDGACEGSPLEEKASPPIETDLQNQACQGSDSDTRLVSGYSLTPLEKTPGTWK

SEQ ID NO: 4745 - protein, 1227 aa, Homo sapiens
MVLAAAMSQDADPSGPEQPDRVACSVPGARASPAPSGPRGMQQPPPPPQPPPPPQAGLPQIIQNAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEDYASNLGTSYVPIPARSFTQSSPTFPLASVGTTFAQRKGAGRVVHICNLPEGSCTENDVINLGLPFGKVTNYILMKSTNQAFLEMAYTEAAQAMVQYYQEKSAVINGEKLLIRMSKRYKELQLKKPGKAVAAIIQDIHSQRERDMFREADRYGPERPRSRSPVSRSLSPRSHTPSFTSCSSSHSPPGPSRADWGNGRDSWEHSPYARREEERDPAPWRDNGDDKRDRMDPWAHDRKHHPRQLDKAELDERPEGGRPHREKYPRSGSPNLPHSVSSYKSREDGYYRKEPKAKWDKYLKQQQDAPGRSRRKDEARLRESRHPHPDDSGKEDGLGPKVTRAPEGAKAKQNEKNKTKRTDRDQEGADDRKENTMAENEAGKEEQEGMEESPQSVGRQEKEAEFSDPENTRTKKEQDWESESEAEGESWYPTNMEELVTVDEVGEEEDFIVEPDIPELEEIVPIDQKDKICPETCLCVTTTLDLDLAQDFPKEGVKAVGNGAAEISLKSPRELPSASTSCPSDMDVEMPGLNLDAERKPAESETGLSLEDSDCYEKEAKGVESSDVHPAPTVQQMSSPKPAEERARQPSPFVDDCKTRGTPEDGACEGSPLEEKASPPIETDLQNQACQEVLTPENSRYVEMKSLEVRSPEYTEVELKQPLSLPSWEPEDVFSELSIPLGVEFVVPRTGFYCKLCGLFYTSEETAKMSHCRSAVHYRNLQKYLSQLAEEGLKETEGADSPRPEDSGIVPRFERKKL

SEQ ID NO: 4746 - protein, 371 aa, Homo sapiens
MATSLGSNTYNRQNWEDADFPILCQTCLGENPYIRMTKEKYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 4747 - protein, 420 aa, Homo sapiens
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 4748 - protein, 371 aa, Homo sapiens
MATSLGSNTYNRQNWEDADFPILCQTCLGENPYIRMEREKSGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 4749 - protein, 423 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 4750 - protein, 439 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 4751 - protein, 405 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGEPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 4752 - protein, 75 aa, Homo sapiens
MASDDFDIVIEAMLEAPYKKEEDEQQRKEVKKDYPSNTTSSTSNSGNETSGSSTIGETSKKKRSRSHNKSRDRKR

SEQ ID NO: 4753 - protein, 60 aa, Homo sapiens
MASDDFDIVIEAMLEAPYKKEEDEQQRKEVKKDYPSNTTSSTSNSGNETSGSSTIGETSK

SEQ ID NO: 4754 - protein, 91 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDR

SEQ ID NO: 4755 - protein, 101 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRD

SEQ ID NO: 4756 - protein, 416 aa, Homo sapiens
MSNKGKKLKRIILAIPPAAPATVAMRPVEAAPSGRQARRRGVGAIIKAGIESAVVVEIGIGIDGEIVGAEVQVGSVVRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 4757 - protein, 144 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGEPVDNLSPEE

SEQ ID NO: 4758 - protein, 66 aa, Homo sapiens
MASDDFDIVIEAMLEAPYKKEEDEQQRKEVKKDYPSNTTSSTSNSGNETSGSSTIGETSNRSRDRD

SEQ ID NO: 4759 - protein, 57 aa, Homo sapiens
MASDDFDIVIEAMLEAPYKKEEDEQQRKEVKKDYPSNTTSSTSNSGNETSGSSTIGE

SEQ ID NO: 4760 - protein, 92 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSR

SEQ ID NO: 4761 - protein, 100 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSR

SEQ ID NO: 4762 - protein, 236 aa, Homo sapiens
MHTTQKDTTYTKIFVGGLPYHTTDASLRKYFEVFGEIEEAVVITDRQTGKSRGYGFVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 4763 - protein, 191 aa, Homo sapiens
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 4764 - protein, 178 aa, Homo sapiens
MADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 4765 - protein, 127 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQ

SEQ ID NO: 4766 - protein, 300 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKVVFLSFHLIPI

SEQ ID NO: 4767 - protein, 243 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKED

SEQ ID NO: 4768 - protein, 843 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 4769 - protein, 843 aa, Homo sapiens; identical to SEQ ID NO: 4768

SEQ ID NO: 4770 - protein, 294 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKRSYGD

SEQ ID NO: 4771 - protein, 294 aa, Homo sapiens; identical to SEQ ID NO: 4770

SEQ ID NO: 4772 - protein, 980 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 4773 - protein, 1007 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQNVTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 4774 - protein, 983 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 4775 - protein, 1060 aa, Homo sapiens
MLIEDVDALKSWLAKLLEPICDADPSALANYVVALVKKDKPEKELKAFCADQLDVFLQKETSGFVDKLFESLYTKNYLPLLEPVKPEPKPLVQEKEEIKEEVFQEPAEEERDGRKKKYPSPQKTRSESSERRTREKKREDGKWRDYDRYYERNELYREKYDWRRGRSKSRSKSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSERQPMYSREHGAAASERLQLGTPPPLLAARLVPPRNLMGSSIGYHTSVSSPTPLVPDTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 4776 - protein, 759 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 4777 - protein, 28 aa, Homo sapiens
MHGRGRGVAGPMGRGRLMPNKQNLRVVE

SEQ ID NO: 4778 - protein, 268 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLGNFFACLPSSFTLISTSSIVLL

SEQ ID NO: 4779 - protein, 1170 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGGGESDGFFHPEGQPQRLPQPPEVGPQPARKVTLTRGGLQQPPHLPAGPHAHSPVPPGIKSIQGIHPAKKAIMHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 4780 - protein, 106 aa, Homo sapiens
MHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 4781 - protein, 430 aa, Homo sapiens
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 4782 - protein, 211 aa, Homo sapiens
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADSSPFRLMLRPCLSISSNTLYCIYRFTIYFWESALASADLEEEIHQKQGQKRKNSQPGVKVADRKILDDTEDTVVSQRKKIQINQEEERLK

SEQ ID NO: 4783 - protein, 211 aa, Homo sapiens; identical to SEQ ID NO: 4782

SEQ ID NO: 4784 - protein, 425 aa, Homo sapiens
MSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 4785 - protein, 239 aa, Homo sapiens
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 4786 - protein, 121 aa, Homo sapiens
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTG

SEQ ID NO: 4787 - protein, 158 aa, Homo sapiens
MADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 4788 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 4789 - protein, 373 aa, Homo sapiens
MQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 4790 - protein, 524 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 4791 - protein, 337 aa, Homo sapiens
  misc_feature (1)..(1): Xaa can be any naturally occurring amino acid
XSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIA

SEQ ID NO: 4792 - protein, 231 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEK

SEQ ID NO: 4793 - protein, 508 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 4794 - protein, 423 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEALFVIMFWNEIWSDNMITLQL

SEQ ID NO: 4795 - protein, 193 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRS

SEQ ID NO: 4796 - protein, 177 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGEPPSLGRGLNTRLCAENGWISKRRGLVKITAVGWLVMKK

SEQ ID NO: 4797 - protein, 364 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 4798 - protein, 364 aa, Homo sapiens; identical to SEQ ID NO: 4797

SEQ ID NO: 4799 - protein, 177 aa, Homo sapiens; identical to SEQ ID NO: 4796

SEQ ID NO: 4800 - protein, 364 aa, Homo sapiens; identical to SEQ ID NO: 4797

SEQ ID NO: 4801 - protein, 203 aa, Homo sapiens
  misc_feature (1)..(1): Xaa can be any naturally occurring amino acid
XVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKGIIPEEP

SEQ ID NO: 4802 - protein, 413 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATGSTTEISGS

SEQ ID NO: 4803 - protein, 405 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATG

SEQ ID NO: 4804 - protein, 205 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKGIIPNPP

SEQ ID NO: 4805 - protein, 311 aa, Homo sapiens
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKDEPQKKNKGDPMNNLESFYQEMIMKKRLEEFQLMRGLTSFPREDFQNLSYEGTTSVLGAKWQKRTGRTSTFSILLVSLLSETVFTSSAMYGIPHLLTMSLKFSTRIGKLSFTP

SEQ ID NO: 4806 - protein, 480 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAVAPQRAPILRPAFVPHVLQRADSALSSAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 4807 - protein, 451 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 4808 - protein, 357 aa, Homo sapiens
MASVLNVKESKAPERTVVVAGLPVDLFSDQLLAVLVKSHFQDIKNEGGDVEDVIYPTRTKGVAYVIFKEKKVAENVIRQKKHWLARKTRHAELTVSLRVSHFGDKIFSSVNAILDLSVFGKEVTLETLVKDLKKKIPSLSFSPLKPNGRISVEGSFLAVKRLRESLLARACSLLEKDRNFTSEERKWNRQNPQRNLQRSNNSLASVRTLVPETARSGEMLVLDTDVFLYLKHKCGSYESTLKKFHILSQEKVDGEITTICLKSIQVGSQPNNAKHVKELIEEWSHALYLKLRKETFILEGKENREKRMIKRACEQLSSRYLEVLINLYRTHIDIIGSSSDTYLFKKGVMKLIGQKVS

SEQ ID NO: 4809 - protein, 1052 aa, Homo sapiens
MMQATAVVETASGKGYHSNGGNLQKDKPSNPKKENLLLSSNGCDEVKLTFPDDDWNSSTLEQRANNKEISNIDKMDLLEPFFSVSQDTNTESTQFQSSELEDSTDYAFLNKTYSIPYSESKLKKESLTPLSSELDPEVQKKEEVFFNILEHQDKTVGLERIYNISDANYRESAEDTQKHDTDEDSQQEYHSAEEQEYISNHLSFDQTKALDISNPEVVELGNSGYEVKCASNVEDNRVNSGSGSIISFDSLDVYGQEESLHVSKFQNSVMLREYHDLKHEKYKEQETNSMYHTVFDGSVLRSNSPGNQESQSKSGSLSPQKVLKMKIYTENMKSQINEGKDFCGNKIVENKILLHLENPSTLPQDKALETLLQPCKDCQTSWTSVFDDSIISACGYYESLQNTADSALDFSAMLPKIAVRDNQAIEDNTSLKVAHSSTTKKTCFHNIGEMCTKSLTDAASCTVTINQTVDVSTDFRACFTTSRATSARPSVVSTSSNTEITMMNKKRPDEWQNEKQKSVACSTDWSYSEDCIDTQMAITKGSGKSLSVDSLKPNGNFLNKDFLELRKACGITDLKKHPEREFQLFKDTEKDLPSMCCQKIMQRAIKAELHLLNVHYQMCRRHCCDIYKLVMENREGLNMNLSSNSAKKELGSALLSLLGDLKVRYVTLKEKIHKGIPLEELPPLSLESKLLSTFSTFASRLMKKETHVFSEADAEQDNQRAHDVDVSSNLKKTLSQMSLSSDNSHATQNISPKKDDFKNGDINADFSQLKLGDKDCRHYQETSEDWSDAKESLTGVDVSGTQGNQVEQDTWNLDLTGEMKNVEPSQRDKGYLIHVGGLCPSVSEADLRSHFQKYQVSEISIYDSTNYRYASLAFTKNSDAKIAVKEMNGIEINGKSVNVWPVKILGEYTSPLSSKNGNRISSNNLEKSTNKQIHSEFSISRLPRTRPRQLGSEQDSEVFPSDQGVKKNCKQIESAKLLPDTPVQFIPPNTLNLRSFTKIIKRLAELHPEVSRDHIINALQEVRIRHKGFLNGLSITTIVEMTSSLLKNSASS

SEQ ID NO: 4810 - protein, 1052 aa, Homo sapiens; identical to SEQ ID NO: 4809

SEQ ID NO: 4811 - protein, 474 aa, Homo sapiens
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVFIAQSRSSGSHRDVEDEELTRIFVMIPKSYTEEDLREKFKVYGDIEYCSIIKNKVTGESKGLGYVRYLKPSQAAQAIENCDRSFRAILAEPKNKASESSEQDYYSNMRQEALGHEPRVNMFPFEQQSEFSSFDKNDSRGQEAISKRLSVVSRVPFTEEQLFSIFDIVPGLEYCEVQRDPYSNYGHGVVQYFNVASAIYAKYKLHGFQYPPGNRIGVSFIDDGSNATDLLRKMATQMVAAQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 4812 - protein, 135 aa, Homo sapiens
  misc_feature (1)..(1): Xaa can be any naturally occurring amino acid
XQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 4813 - protein, 533 aa, Homo sapiens
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLDYNFHRSSINSLSPVSATLSSGTPSVLPYTSRPYSYPGYPLSPTISLANGSHVGQRLCISNQASFF

SEQ ID NO: 4814 - protein, 593 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 4815 - protein, 593 aa, Homo sapiens; identical to SEQ ID NO: 4814

SEQ ID NO: 4816 - protein, 59 aa, Homo sapiens
MTAEDSTAAMSSDSAAGSSAKVPEGVAGAPNEAALLALMERTGYSMVQENGQRKYGGPP

SEQ ID NO: 4817 - protein, 217 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPG

SEQ ID NO: 4818 - protein, 114 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYA

SEQ ID NO: 4819 - protein, 193 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKN

SEQ ID NO: 4820 - protein, 159 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIP

SEQ ID NO: 4821 - protein, 137 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIR

SEQ ID NO: 4822 - protein, 524 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 4823 - protein, 124 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEA

SEQ ID NO: 4824 - protein, 524 aa, Homo sapiens; identical to SEQ ID NO: 4822

SEQ ID NO: 4825 - protein, 59 aa, Homo sapiens; identical to SEQ ID NO: 4816

SEQ ID NO: 4826 - protein, 126 aa, Homo sapiens
GKMASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFWIASCVLCSRI

SEQ ID NO: 4827 - protein, 360 aa, Homo sapiens [sequence omitted]

SEQ ID NO: 4828 - protein, 367 aa, Homo sapiens
MASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 4829 - protein, 359 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGKRMHVQLSTSRLRTAPGMGDQSGCYRCGKEGHWSKECPVDRTGRVADFTEQYNEQYGAVRTPYTMGYGESMYYNDAYGALDYYKRYRVRSYEAVAAAAAASAYNYAEQTMSHLPQVQSTTVTSHLNSTSVDPYDRHLLPNSGAAATSAAMAAAAATTSSYYGRDRSPLRRAAAMLPTVGEGYGYGPESELSQASAATRNSLYDMARYEREQYVDRARYSAF

SEQ ID NO: 4830 - protein, 359 aa, Homo sapiens; identical to SEQ ID NO: 4829

SEQ ID NO: 4831 - protein, 143 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGESLLSS

SEQ ID NO: 4832 - protein, 815 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 4833 - protein, 137 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTG

SEQ ID NO: 4834 - protein, 814 aa, Homo sapiens
GTKCRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 4835 - protein, 126 aa, Homo sapiens
MGSDKRVSRTERSGRYGSIIDRDDRDERESRSRRRDSDYKRSSDDRRGDRYDDYRDYDSPENDKYSRNDGVLRRPSACGCEADEEENRCKPWFRLRGVLSLARCYQLDGSQSEKVGDSRKAHCNAL

SEQ ID NO: 4836 - protein, 120 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMES

SEQ ID NO: 4837 - protein, 105 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGL

SEQ ID NO: 4838 - protein, 505 aa, Homo sapiens
NGFRSGERDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 4839 - protein, 149 aa, Homo sapiens
GTKCRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTEKVGDSRKAHCNAL

SEQ ID NO: 4840 - protein, 601 aa, Homo sapiens
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 4841 - protein, 601 aa, Homo sapiens; identical to SEQ ID NO: 4840

SEQ ID NO: 4842 - protein, 520 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGNSNDPGQRSYPGVCIKPGFLVLQTM

SEQ ID NO: 4843 - protein, 991 aa, Homo sapiens
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 4844 - protein, 142 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTS

SEQ ID NO: 4845 - protein, 76 aa, Homo sapiens
MWGDSRPANRTGPFRGSQEERFAPGWNRDYPPPPLKSHAQERHSGNFPGRDSLPFDFQGHSGPPFANVEEHSFSYG

SEQ ID NO: 4846 - protein, 465 aa, Homo sapiens
MLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 4847 - protein, 1123 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 4848 - protein, 266 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 4849 - protein, 173 aa, Homo sapiens
MADVLDLHEAGGEDFAMDEDGDESIHKLKEKAKKRKGRGFGSEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 4850 - protein, 174 aa, Homo sapiens
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 4851 - protein, 378 aa, Homo sapiens
MVEADRPGKLFIGGLNTETNEKALEAVFGKYGRIVEVLLMKDRESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 4852 - protein, 391 aa, Homo sapiens
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 4853 - protein, 102 aa, Homo sapiens
  misc_feature (1)..(1): Xaa can be any naturally occurring amino acid
XMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 4854 - protein, 196 aa, Homo sapiens
MVEADRPGKLFIGGLNTETNEKALEAVFGKYGRIVEVLLMKDRETNKSRGFAFVTFESPADAKDAARDMNGKLLYHVEEIVMEVHLEGNRCPLVEMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 4855 - protein, 322 aa, Homo sapiens
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGRSSDAHSSWYNGRSEGRSYRSRSRSRDKSHRHKRARRSRERESSNPSDRWRH

SEQ ID NO: 4856 - protein, 58 aa, Homo sapiens
MNPLTKVKLINELNEREVQLGVADKVSWHSEYKDSAWIFLGGLPYELTEGDIICVFSQ

SEQ ID NO: 4857 - protein, 275 aa, Homo sapiens
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGLRCTF

SEQ ID NO: 4858 - protein, 390 aa, Homo sapiens
MVEADRPGKLFIGGLNTETNEKALETVFGKYGRIVEVLLIKDRETNKSRGFAFVTFESPADAKDAARDMNGKSLDGKAIKVEQATKPSFERGRHGPPPPPRSRGPPRGFGAGRGGSGGTRGPPSRGGHMDDGGYSMNFNMSSSRGPLPVKRGPPPRSGGPSPKRSAPSGLVRSSSGMGGRAPLSRGRDSYGGPPRREPLPSRRDVYLSPRDDGYSTKDSYSSRDYPSSRDTRDYAPPPRDYTYRDYGHSSSRDDYPSRGYGDRDGYGRDRDYSDHPSGGSYRDSYESYGNSRSAPLTRGPPPSYGGSSRYDDYSSSRDGYGGSRDSYSSSRSDLYSSCDRVGRQERGLPPSVERGYPSSRDSYSSSSRGAPRGAGPGGSRSDRGGGRSRY

SEQ ID NO: 4859 - protein, 390 aa, Homo sapiens; identical to SEQ ID NO: 4858

SEQ ID NO: 4860 - protein, 392 aa, Homo sapiens
MVEADRPGKLFIGGLNLETDEKALEAEFGKYGRIVEVLLMKDRETNKSRGFAFVTFESPADAKAAARDMNGKSLDGKAIKVAQATKPAFESSRRGPPPPRSRGRPRFLRGTRGGGGGPRRSPSRGGPDDDGGYTADFDLRPSRAPMPMKRGPPPRRVGPPPKRAAPSGPARSSGGGMRGRALAVRGRDGYSGPPRREPLPPRRDPYLGPRDEGYSSRDGYSSRDYREPRGFAPSPGEYTHRDYGHSSVRDDCPLRGYSDRDGYGGRDRDYGDHLSRGSHREPFESYGELRGAAPGRGTPPSYGGGGRYEEYRGYSPDAYSGGRDSYSSSYGRSDRYSRGRHRVGRPDRGLSLSMERGCPPQRDSYSRSGCRVPRGGGRLGGRLERGGGRSRY

SEQ ID NO: 4861 - protein, 1067 aa, Homo sapiens
MMEADRPEKLFIGGLNLKTDEKALKAEFGKYGHIIKVFLMKDRKTNKSRGFAFVTFESPADAKAAARDMNGKYLDGKAIMVAQTIKPAFKSSRWVPPTPGSGSRSRFSHRTRGGGSSPQRPPSQGRPDDGRGYAGYFDLWPYRAPMPRKRGPPPRHWASPPHKRATPSSLAHSVGCGMRGKAPTVSGQDGYSGLQPRRWAGPPHKRAVPRSSLARIGGSGMPGKAPAVWGQDGYSGPRVREPLPPCRDPGDFVPALRDYSRRYYGHSSVPDYRPLRGDGNQNGYRGRDHEYTDHPSKGSYREPLKSYGGPCGAAPVWGTPPSYGGGCRYEEYQGNSPDACSEGRSSEALPVVLPDAYSRDHSPKAYSGGRSSSSNGYSRSDRYGEEGCYEEYRGRSPDAHSGGRNSSSNSYGQSHHYGGEGRYEEYRGRSHEARSGGRSTDAHSRGRSDDAYSGGHDSSSWSDCCGGGGRYEEYQGRSLDANSGGCSPEAYSGGHDNSSWSDRYGVGGHYEENRGHSLDANSGGRSPDTHSGGHSSSSNSYGQSHRYGGEGRYEYRGRSHDAHSGGCSADAYSGGHDSSSQSNRYGGGGCYEEYRGRSLDANSGGRSPNAYSGGHDSSSWSHRYGGGGRYEEYRGRSLDANSGGRSPDAYSGGHDSSGQSNCYGGGGRYEEYRGRLLDANSGGRSPDAYSGGHDSSSQSNRYGGGGRYEEYRGHSLDANSGGRSPDTYSRGHDSSSQSDHYGGGGRSLDANSSGRLPDAYSGGHDSSSRSHRYGGGGRYEEYRGRSLDANSGGRSPNAYSGGHNSSSRNDPCRGGGRYEENRGHSLDANSGGHSPNAYSGGRDSSSNSYDRSHRYGGGGHYEEYRGRSHDTHSRGRSPDAHSGDHYTEAYSRGRDSFSNSYGRSDHYGRGGCYEEYQGRSPNAYGGGRGLNSSNNSHGRSHRYGGGGRYEEYRGPSPDAHSGGRDSSIKSYGLSDRYGGGGHYEEYQGSLPDAYSGDHDRSSNSYGRSDRYSRGRDRVGRPDRGLPLPMETGSPPLHDSYSRSGCRVPRGGGRQGGRFERGEGRSRY

SEQ ID NO: 4862 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4863 - protein, 289 aa, Homo sapiens
MSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4864 - protein, 496 aa, Homo sapiens; identical to SEQ ID NO: 4862

SEQ ID NO: 4865 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 4866 - protein, 459 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4867 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4868 - protein, 496 aa, Homo sapiens; identical to SEQ ID NO: 4867

SEQ ID NO: 4869 - protein, 459 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4870 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 4871 - protein, 496 aa, Homo sapiens; identical to SEQ ID NO: 4867

SEQ ID NO: 4872 - protein, 496 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 4873 - protein, 459 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 4874 - protein, 496 aa, Homo sapiens; identical to SEQ ID NO: 4872

SEQ ID NO: 4875 - protein, 496 aa, Homo sapiens; identical to SEQ ID NO: 4872

SEQ ID NO: 4876 - protein, 459 aa, Homo sapiens; identical to SEQ ID NO: 4873

SEQ ID NO: 4877 - protein, 406 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 4878 - protein, 128 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENML

SEQ ID NO: 4879 - protein, 370 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 4880 - protein, 370 aa, Homo sapiens; identical to SEQ ID NO: 4879

SEQ ID NO: 4881 - protein, 419 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVAKETRENKYRGSAIKVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 4882 - protein, 370 aa, Homo sapiens; identical to SEQ ID NO: 4879

SEQ ID NO: 4883 - protein, 407 aa, Homo sapiens
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 4884 - protein, 436 aa, Homo sapiens
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 4885 - protein, 437 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 4886 - protein, 419 aa, Homo sapiens
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 4887 - protein, 433 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 4888 - protein, 434 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSKP

SEQ ID NO: 4889 - protein, 420 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 4890 - protein, 305 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 4891 - protein, 305 aa, Homo sapiens; identical to SEQ ID NO: 4890

SEQ ID NO: 4892 - protein, 305 aa, Homo sapiens; identical to SEQ ID NO: 4890

SEQ ID NO: 4893 - protein, 196 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQMRWLPPSEATSQGWKSRQFC

SEQ ID NO: 4894 - protein, 204 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQLCEGQTVRRSHPLSAPSPDSASLAWFPV

SEQ ID NO: 4895 - protein, 219 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 4896 - protein, 153 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPLMRWLPPSEATSQGWKSRQFC

SEQ ID NO: 4897 - protein, 196 aa, Homo sapiens; identical to SEQ ID NO: 4893

SEQ ID NO: 4898 - protein, 209 aa, Homo sapiens
MSNLKPDGEHGGSTGTGSGAGSGGALEEEVRTLFVSGLPVDIKPRELYLLFRPFKGYEGSLIKLTARQPVGFVIFDSRAGAEAAKNALNGIRFDPENPQTLRLEFAKANTKMAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 4899 - protein, 306 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 4900 - protein, 237 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSS

SEQ ID NO: 4901 - protein, 181 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIK

SEQ ID NO: 4902 - protein, 89 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINM

SEQ ID NO: 4903 - protein, 290 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 4904 - protein, 418 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 4905 - protein, 397 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 4906 - protein, 395 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDRNQFVFVAADEISCNTSAVTDEFMLPTPTTTHLLQPPPTALVP

SEQ ID NO: 4907 - protein, 370 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 4908 - protein, 392 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMASIYRGGYNRFAPY

SEQ ID NO: 4909 - protein, 391 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 4910 - protein, 402 aa, Homo sapiens
MIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 4911 - protein, 397 aa, Homo sapiens; identical to SEQ ID NO: 4905

SEQ ID NO: 4912 - protein, 466 aa, Homo sapiens
METGQRTHASGTYSFLDRTQHSDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVPCPKVPAPAQTSEELSCTLPGLCCQAAENLTASPPLLQFMFKVIVAQERK

SEQ ID NO: 4913 - protein, 263 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATA

SEQ ID NO: 4914 - protein, 357 aa, Homo sapiens
MVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4915 - protein, 128 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGFGKILDVEIIFNERGS

SEQ ID NO: 4916 - protein, 400 aa, Homo sapiens
MKNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYIESANCFRSNRVDMQPTDMHSLLLQPQPPLLQPLQPLTVTVMAGCTQPTPTMPLPLPLAMELALWRVYTEVATADLPPTEVT

SEQ ID NO: 4917 - protein, 200 aa, Homo sapiens
MSSDSMDQPRNPCENEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEG

SEQ ID NO: 4918 - protein, 451 aa, Homo sapiens
MAEGAQPHQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4919 - protein, 370 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYIESANCFRSNRVDMQPTDMHSLLLQPQPPLLQPLQPLTVTVMAGCTQPTPTMPLPLPLAMELALWRVYTEVATADLPPTEVT

SEQ ID NO: 4920 - protein, 358 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4921 - protein, 367 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 4922 - protein, 380 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4923 - protein, 370 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 4924 - protein, 376 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4925 - protein, 312 aa, Homo sapiens
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 4926 - protein, 312 aa, Homo sapiens; identical to SEQ ID NO: 4925

SEQ ID NO: 4927 - protein, 995 aa, Homo sapiens
MSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKTKQKCAAQPHTVRRTKKLKVEEETSKASNLEGESNSSETPSTSTVWGGTCKKEENDDDFTFGQSALKKIKTETYPQGQPVKFPANANSTKEEVEMNWDMVQVLSERTNIEPWVCANIIRLFNDDNTIPFIIRYRKELINNLDADSLREVQQTLEELRAVAKKVHSTIQKIKKEGKMSECLLKAMLNCKTFEELEHVSAPYKTGSKGTKAQRARQLGLEGAARALLEKPGELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 4928 - protein, 514 aa, Homo sapiens
MKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 4929 - protein, 408 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 4930 - protein, 393 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 4931 - protein, 387 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 4932 - protein, 402 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 4933 - protein, 136 aa, Homo sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAPTTAATTAATAAQ

SEQ ID NO: 4934 - protein, 94 aa, Homo sapiens
MRSIRSFANDDRHVMVKHSTIYPSPEELEAVQNMVSTVECALKHVSDWLDETNKGTKTEGETEVKKDEAGENYSKWSDIVWCNEDWPGCKRLAD

SEQ ID NO: 4935 - protein, 672 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 4936 - protein, 74 aa, Homo sapiens
MRSIRSFANDDRHVMVKHSTIYPSPEELEAVQNMVSTVECALKHVSDWLDETNKGTKTEGETEVKKDEAGENYS

SEQ ID NO: 4937 - protein, 672 aa, Homo sapiens; identical to SEQ ID NO: 4935

SEQ ID NO: 4938 - protein, 658 aa, Homo sapiens
MVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 4939 - protein, 109 aa, Homo sapiens
MAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSDDEKKDF

SEQ ID NO: 4940 - protein, 577 aa, Homo sapiens
MSQVQVQVQNPSAALSGSQILNKNQSLLSQPLMSIPSTTSSLPSENAGRPIQNSALPSASITSTSAAAESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 4941 - protein, 496 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 4942 - protein, 502 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 4943 - protein, 496 aa, Homo sapiens; identical to SEQ ID NO: 4941

SEQ ID NO: 4944 - protein, 502 aa, Homo sapiens; identical to SEQ ID NO: 4942

SEQ ID NO: 4945 - protein, 129 aa, Homo sapiens
MCEVSRGWKPCTEGILKVRPTRKISYEGNITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLE

SEQ ID NO: 4946 - protein, 496 aa, Homo sapiens; identical to SEQ ID NO: 4941

SEQ ID NO: 4947 - protein, 496 aa, Homo sapiens; identical to SEQ ID NO: 4941

SEQ ID NO: 4948 - protein, 494 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 4949 - protein, 199 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVK

SEQ ID NO: 4950 - protein, 479 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 4951 - protein, 570 aa, Homo sapiens
MANPKEKTAMCLVNELARFNRVQPQYKLLNERGPAHSKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 4952 - protein, 105 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQR

SEQ ID NO: 4953 - protein, 538 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 4954 - protein, 479 aa, Homo sapiens; identical to SEQ ID NO: 4950

SEQ ID NO: 4955 - protein, 64 aa, Homo sapiens
MLQINQMFSVQLSLGEQTWESEGSSIKKAQQAVANKALTESTLPKPVQKPPKSNVNNNPGSITP

SEQ ID NO: 4956 - protein, 204 aa, Homo sapiens
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHM

SEQ ID NO: 4957 - protein, 1621 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 4958 - protein, 345 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 4959 - protein, 366 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 4960 - protein, 386 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 4961 - protein, 463 aa, Homo sapiens
PLVSRETPLSCSHNRLNDLGGSEGQGAGPGGAAATAAAMEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYECRCIGEEKEMWNFGEKYARFCSRRLIAEIDEKQIKTTIQKSNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 4962 - protein, 375 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 4963 - protein, 132 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTN

SEQ ID NO: 4964 - protein, 375 aa, Homo sapiens
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 4965 - protein, 85 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKIS

SEQ ID NO: 4966 - protein, 392 aa, Homo sapiens
MMEDDGQPRTLYVGNLSRDVTEVLILQLFSQIGPCKSCKMITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 4967 - protein, 252 aa, Homo sapiens
MDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 4968 - protein, 217 aa, Homo sapiens
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 4969 - protein, 1074 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSVATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 4970 - protein, 189 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPAATEAGSSSSCCCCCNSCLDRDHLY

SEQ ID NO: 4971 - protein, 1056 aa, Homo sapiens
MATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSVATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGMDLKLRGKKTKKIMITFKKCL

SEQ ID NO: 4972 - protein, 70 aa, Homo sapiens
MATSQYFDFAQGGGPQYSPEVETTPPALASGLPCALPWTVGCSGSDAVTALCPSLRGLACICSILWDPAW

SEQ ID NO: 4973 - protein, 939 aa, Homo sapiens
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKVFKLHAKLGKPIPTLEPALATESPPGAEAKPTSPTGPSVCASSRPALAKRPVASKALCEGPPEPQAAGCRPQWGKPAQPKLEGPGAPTQGGSKEAPAGCSDAQPVGPEYVEEVFSDEGRVLRFHCKLCECSFNDLNAKDLHVRGRRHRLQYRKKVNPDLPIATEPSSRARKVLEERMRKQRHLAEERLEQLRRWHAERRRLEEEPPQDVPPHAPPDWAQPLLMGRPESPASAPLQPGRRPASSDDRHVMCKHATIYPTEQELLAVQRAVSHAERALKLVSDTLAEEDRGRREEEGDKRSSVAPQTRVLKGVMRVGILAKGLLLRGDRNVRLALLCSEKPTHSLLRRIAQQLPRQLQMVTEDEYEVSSDPEANIVISSCEEPRMQVTISVTSPLMREDPSTDPGVEEPQADAGDVLSPKKCLESLAALRHARWFQARASGLQPCVIVIRVLRDLCRRVPTWGALPAWAMELLVEKAVSSAAGPLGPGDAVRRVLECVATGTLLTDGPGLQDPCERDQTDALEPMTLQEREDVTASAQHALRMLAFRQTHKVLGMDLLPPRHRLGARFRKRQRGPGEGEEGAGEKKRGRRGGEGLV

SEQ ID NO: 4974 - protein, 366 aa, Homo sapiens
MATSQYFDFAQGGGPQYSAQPPTLPLPTVGASYTAQPTPGMDPAVNPAFPPAAPAGYGGYQPHSGQDFAYGSRPQEPVPTATTMATYQDSYSYGQSAAARSYEDRPYFQSAALQSGRMTAADSGQPGTQEACGQPSPHGSHSHAQPPQQAPIVESGQPASTLSSGYTYPTATGVQPESSASIVTSYPPPSYNPTCTAYTAPSYPNYDASVYSAASPFYPPAQPPPPPGPPQQLPPPPAPAGSGSSPRADSKPPLPSKLPRPKAGPRQLQLHYCDICKISCAGPQTYREHLGGQKHRKKEAAQKTGVQPNGSPRGVQAQLHCDLCAVSCTGADAYAAHIRGSKHQKGLLSHRQQAADPSGGNQPNLN

SEQ ID NO: 4975 - protein, 767 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 4976 - protein, 767 aa, Homo sapiens; identical to SEQ ID NO: 4975

SEQ ID NO: 4977 - protein, 798 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 4978 - protein, 813 aa, Homo sapiens
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 4979 - protein, 844 aa, Homo sapiens
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 4980 - protein, 46 aa, Homo sapiens
MSFDPNLLHNNGHNGYPNGTSAALRETGVIEKLLTSYGFIQCSERQ

SEQ ID NO: 4981 - protein, 7 aa, Homo sapiens
MSFDPNL

SEQ ID NO: 4982 - protein, 668 aa, Homo sapiens
MNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 4983 - protein, 95 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEIL

SEQ ID NO: 4984 - protein, 798 aa, Homo sapiens; identical to SEQ ID NO: 4977

SEQ ID NO: 4985 - DNA, 824 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagtagtgctttctactttatgtggtctttgaataaagcctgagtaggaaggcggccgctcgagcatgcatctaga

SEQ ID NO: 4986 - RNA, 782 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguagugcuuucuacuuuauguggucuuugaauaaagccugaguaggaag

SEQ ID NO: 4987 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctactttattggtctttgaataaagcctgagtaggaaggcggccgctcgagcatgcatctaga

SEQ ID NO: 4988 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacuuuauuggucuuugaauaaagccugaguaggaag

SEQ ID NO: 4989 - DNA, 817 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagtagtgctttctgtggtctttgaataaagcctgagtaggaaggcggccgctcgagcatgcatctaga

SEQ ID NO: 4990 - RNA, 775 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguagugcuuucuguggucuuugaauaaagccugaguaggaag

SEQ ID NO: 4991 - DNA, 826 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctcttccataaagtaggaaacactacatggtctttgaataaagcctgagtaggaaggcggccgctcgagcatgcatctaga

SEQ ID NO: 4992 - RNA, 784 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuccauaaaguaggaaacacuacauggucuuugaauaaagccugaguaggaag

SEQ ID NO: 4993 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctacactactggtctttgaataaagcctgagtaggaaggcggccgctcgagcatgcatctaga

SEQ ID NO: 4994 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacacuacuggucuuugaauaaagccugaguaggaag

SEQ ID NO: 4995 - DNA, 819 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctcttccataaagtaggaaatggtctttgaataaagcctgagtaggaaggcggccgctcgagcatgcatctaga

SEQ ID NO: 4996 - RNA, 777 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuccauaaaguaggaaauggucuuugaauaaagccugaguaggaag

SEQ ID NO: 4997 - DNA, 825 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctaacccatggaattcagttctcatggtctttgaataaagcctgagtaggaaggcggccgctcgagcatgcatctaga

SEQ ID NO: 4998 - RNA, 783 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaacccauggaauucaguucucauggucuuugaauaaagccugaguaggaag

SEQ ID NO: 4999 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagttctctggtctttgaataaagcctgagtaggaaggcggccgctcgagcatgcatctaga

SEQ ID NO: 5000 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguucucuggucuuugaauaaagccugaguaggaag

SEQ ID NO: 5001 - DNA, 818 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctaacccatggaattcatggtctttgaataaagcctgagtaggaaggcggccgctcgagcatgcatctaga

SEQ ID NO: 5002 - RNA, 776 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaacccauggaauucauggucuuugaauaaagccugaguaggaag

SEQ ID NO: 5003 - DNA, 1436 bp, Artificial Sequence
  Description of Artificial Sequence: Synthetic Transcript Sequence
taatacgactcactatagggaaataagagagaaaagaagagtaagaagaaatataagagccacctcgtgaggatctatttccggtgaattcctcgagactagttctagagcggccgcggatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcacctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggctctaga

SEQ ID NO: 5004 - RNA, 1413 nt, Artificial Sequence
  Description of Artificial Sequence: Synthetic Transcript Sequence
gggaaauaagagagaaaagaagaguaagaagaaauauaagagccaccucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5005 - DNA, 1430 bp, Artificial Sequence
  Description of Artificial Sequence: Synthetic Transcript Sequence
taatacgactcactatagggaaataagagagaaaagaagagtaagaagaaatataagatcgtgaggatctatttccggtgaattcctcgagactagttctagagcggccgcggatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcacctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggctctaga

SEQ ID NO: 5006 - RNA, 1407 nt, Artificial Sequence
  Description of Artificial Sequence: Synthetic Transcript Sequence
gggaaauaagagagaaaagaagaguaagaagaaauauaagaucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5007 - DNA, 795 bp, Artificial Sequence
  Description of Artificial Sequence: Synthetic Transcript Sequence
taatacgactcactatagggaaataagagagaaaagaagagtaagaagaaatataagaatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggctctaga

SEQ ID NO: 5008 - RNA, 772 nt, Artificial Sequence
  Description of Artificial Sequence: Synthetic Transcript Sequence
gggaaauaagagagaaaagaagaguaagaagaaauauaagaauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5009 - DNA, 1518 bp, Artificial Sequence
  Description of Artificial Sequence: Synthetic Transcript Sequence
taatacgactcactatagggaaataagagagaaaagaagagtaagaagaaatataagagccacctcgtgaggatctatttccggtgaattcctcgagactagttctagagcggccgcggatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcacctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaggcgcgcc

SEQ ID NO: 5010 - RNA, 1493 nt, Artificial Sequence
  Description of Artificial Sequence: Synthetic Transcript Sequence
gggaaauaagagagaaaagaagaguaagaagaaauauaagagccaccucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5011 - DNA, 1512 bp, Artificial Sequence
  Description of Artificial Sequence: Synthetic Transcript Sequence
taatacgactcactatagggaaataagagagaaaagaagagtaagaagaaatataagatcgtgaggatctatttccggtgaattcctcgagactagttctagagcggccgcggatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcacctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaggcgcgcc

SEQ ID NO: 5012 - RNA, 1487 nt, Artificial Sequence
  Description of Artificial Sequence: Synthetic Transcript Sequence
gggaaauaagagagaaaagaagaguaagaagaaauauaagaucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5013 - DNA, 883 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaggcgcgcc

SEQ ID NO: 5014 - RNA, 858 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5015 - DNA, 877 bp, Artificial Sequence
  Description of Artificial Sequence: Synthetic Transcript Sequence
taatacgactcactatagggaaataagagagaaaagaagagtaagaagaaatataagaatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaggcgcgcc

SEQ ID NO: 5016 - RNA, 852 nt, Artificial Sequence
  Description of Artificial Sequence: Synthetic Transcript Sequence
gggaaauaagagagaaaagaagaguaagaagaaauauaagaauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5017 - DNA, 823 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtaccccccaaacaccattgtcacactccagtggtctttgaataaagtctgagtgggcggctctaga

SEQ ID NO: 5018 - RNA, 800 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 5019 - DNA, 808 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtacccccacactccgtggtctttgaataaagtctgagtgggcggctctaga

SEQ ID NO: 5020 - RNA, 785 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccacacuccguggucuuugaauaaagucugagugggcggc

SEQ ID NO: 5021 - DNA, 816 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctggagcctcggtggccatgcttcttgccccttgggcctccccccagcccctcctccccttcctgcacccgtaccccccaaacaccattgtcagtggtctttgaataaagtctgagtgggcggctctaga

SEQ ID NO: 5022 - RNA, 793 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguaccccccaaacaccauugucaguggucuuugaauaaagucugagugggcggc

SEQ ID NO: 5023 - DNA, 825 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctcaaacaccattgtcacactccatggtctttgaataaagcctgagtaggaaggcggccgctcgagcatgcatctaga

SEQ ID NO: 5024 - RNA, 783 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucucaaacaccauugucacacuccauggucuuugaauaaagccugaguaggaag

SEQ ID NO: 5025 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctacactcctggtctttgaataaagcctgagtaggaaggcggccgctcgagcatgcatctaga

SEQ ID NO: 5026 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacacuccuggucuuugaauaaagccugaguaggaag

SEQ ID NO: 5027 - DNA, 818 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctcaaacaccattgtcatggtctttgaataaagcctgagtaggaaggcggccgctcgagcatgcatctaga

SEQ ID NO: 5028 - RNA, 776 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucucaaacaccauugucauggucuuugaauaaagccugaguaggaag

SEQ ID NO: 5029 - DNA, 1594 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctggagcctcggtggccatgcttcttgccccttgggcctccccccagcccctcctccccttcctgcacccgtaccccccaaacaccattgtcacactccagtggtctttgaataaagtctgagtgggcggctctaga

SEQ ID NO: 5030 - RNA, 1571 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 5031 - DNA, 1579 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctggagcctcggtggccatgcttcttgccccttgggcctccccccagcccctcctccccttcctgcacccgtacccccacactccgtggtctttgaataaagtctgagtgggcggctctaga

SEQ ID NO: 5032 - RNA, 1556 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguacccccacacuccguggucuuugaauaaagucugagugggcggc

SEQ ID NO: 5033 - DNA, 1587 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctggagcctcggtggccatgcttcttgccccttgggcctccccccagcccctcctccccttcctgcacccgtaccccccaaacaccattgtcagtggtctttgaataaagtctgagtgggcggctctaga

SEQ ID NO: 5034 - RNA, 1564 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguaccccccaaacaccauugucaguggucuuugaauaaagucugagugggcggc

SEQ ID NO: 5035 - DNA, 1596 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctgccttctgcggggcttgccttctggccatgcccttcttctctcccttgcacctgtacctctcaaacaccattgtcacactccatggtctttgaataaagcctgagtaggaaggcggccgctcgagcatgcatctaga

SEQ ID NO: 5036 - RNA, 1554 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucucaaacaccauugucacacuccauggucuuugaauaaagccugaguaggaag

SEQ ID NO: 5037 - DNA, 1581 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctgccttctgcggggcttgccttctggccatgcccttcttctctcccttgcacctgtacctctacactcctggtctttgaataaagcctgagtaggaaggcggccgctcgagcatgcatctaga

SEQ ID NO: 5038 - RNA, 1539 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucuacacuccuggucuuugaauaaagccugaguaggaag

SEQ ID NO: 5039 - DNA, 1589 bp, Artificial Sequence
  Description of Artificial Sequence: Synthetic Transcript Sequence
taatacgactcactatagggaaataagagagaaaagaagagtaagaagaaatataagagccaccatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgataataggctgccttctgcggggcttgccttctggccatgcccttcttctctcccttgcacctgtacctctcaaacaccattgtcatggtctttgaataaagcctgagtaggaaggcggccgctcgagcatgcatctaga

SEQ ID NO: 5040 - RNA, 1547 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucucaaacaccauugucauggucuuugaauaaagccugaguaggaag

SEQ ID NO: 5041 - protein, 11 aa, Homo sapiens
MSCSGCNGMWA

SEQ ID NO: 5042 - protein, 11 aa, Homo sapiens
RNSGAGMGRMR

SEQ ID NO: 5043 - protein, 13 aa, Homo sapiens
RNSGAGMGRMRRR

SEQ ID NO: 5044 - protein, 12 aa, Homo sapiens
RMSCSGCNGMWR

SEQ ID NO: 5045 - DNA, 10 bp, Homo Sapiens
gacgagagga

SEQ ID NO: 5046 - DNA, 10 bp, Homo Sapiens
gacgagagaa

SEQ ID NO: 5047 - DNA, 10 bp, Homo Sapiens
cgccgctgaa

SEQ ID NO: 5048 - DNA, 10 bp, Homo Sapiens
cgccgcggaa

SEQ ID NO: 5049 - DNA, 10 bp, Homo Sapiens
cgccgccgaa

SEQ ID NO: 5050 - DNA, 10 bp, Homo Sapiens
agccgccgca

SEQ ID NO: 5051 - DNA, 10 bp, Homo Sapiens
acgccgccga

SEQ ID NO: 5052 - DNA, 12 bp, Homo Sapiens
ggcattcatcgt

SEQ ID NO: 5053 - DNA, 12 bp, Homo Sapiens
gcattagtatct

SEQ ID NO: 5054 - DNA, 12 bp, Homo Sapiens
tcggttattgtt

SEQ ID NO: 5055 - DNA, 12 bp, Homo Sapiens
tccaattgggaa

SEQ ID NO: 5056 - DNA, 12 bp, Homo Sapiens
atctattggcca

SEQ ID NO: 5057 - DNA, 12 bp, Homo Sapiens
ttactgggtgtt

SEQ ID NO: 5058 - DNA, 12 bp, Homo Sapiens
agggtgaaggtc

SEQ ID NO: 5059 - DNA, 12 bp, Homo Sapiens
ggtgggtgtgtc

SEQ ID NO: 5060 - DNA, 12 bp, Homo Sapiens
cgcttcaatgct

SEQ ID NO: 5061 - DNA, 12 bp, Homo Sapiens
tgcttcaatgcc

SEQ ID NO: 5062 - DNA, 12 bp, Homo Sapiens
tgtgtctttgca

SEQ ID NO: 5063 - DNA, 12 bp, Homo Sapiens
cacggggacagc

SEQ ID NO: 5064 - DNA, 12 bp, Homo Sapiens
aagctgtacatg

SEQ ID NO: 5065 - DNA, 12 bp, Homo Sapiens
gatgggggcaca

SEQ ID NO: 5066 - DNA, 12 bp, Homo Sapiens
atatgtgccctt

SEQ ID NO: 5067 - DNA, 12 bp, Homo Sapiens
tccttctgggtc

SEQ ID NO: 5068 - DNA, 12 bp, Homo Sapiens
ggtgggtgtgtc

SEQ ID NO: 5069 - DNA, 12 bp, Homo Sapiens
gaatggatgggg

SEQ ID NO: 5070 - DNA, 12 bp, Homo Sapiens
  modified_base (3)..(3): n = a, c, t or g
  misc_feature (3)..(3): n is a, c, g, or t
cangtgatattc

SEQ ID NO: 5071 - DNA, 12 bp, Homo Sapiens
aggagggtttgt

SEQ ID NO: 5072 - DNA, 12 bp, Homo Sapiens
tgggcgagtggg

SEQ ID NO: 5073 - DNA, 12 bp, Homo Sapiens
cggctcaccagt

SEQ ID NO: 5074 - DNA, 12 bp, Homo Sapiens
  modified_base (7)..(7): n= a, t, c or g
  misc_feature (7)..(7): n is a, c, g, or t
ggtttcnataac

SEQ ID NO: 5075 - DNA, 12 bp, Homo Sapiens
ggtgggtgtgtc

SEQ ID NO: 5076 - DNA, 12 bp, Homo Sapiens
ttactgggtgtt

SEQ ID NO: 5077 - DNA, 12 bp, Homo Sapiens
aagtctttgggt

SEQ ID NO: 5078 - DNA, 90 bp, Homo Sapiens
gggagacggcggcggtggcggcgcgggcagagcaaggacgcggcggatcccactcgcacagcagcgcactcggtgccccgcgcagggtcg

SEQ ID NO: 5079 - DNA, 75 bp, Homo Sapiens
aaagaaatggaatcgaagagaatggaaacaaatggaatggaattgaatggaatggaattgaatggaatgggaacg

SEQ ID NO: 5080 - DNA, 75 bp, Homo Sapiens; identical to SEQ ID NO: 5079

SEQ ID NO: 5081 - DNA, 87 bp, Homo Sapiens
agacagtcagacaatcacaaagaaacaagaatgaaaatgaatgaacaaaaccttcaagaaatatgggattatgaagaggccaaatgt

SEQ ID NO: 5082 - DNA, 78 bp, Homo Sapiens
aaaaggaaatacaagacaacaaacacagaaacacaaccatcgggcatcatgaaacctcgtgaagataatcatcagggt

SEQ ID NO: 5083 - DNA, 88 bp, Homo Sapiens
agaccctaatatcacagttaaacgaactagagaaggaagagcaaacaaattcaaaagctagcggaaagcaagaaataactaagaccag

SEQ ID NO: 5084 - DNA, 90 bp, Homo Sapiens
aaagacttaaacataagacctaaaaccataaaaaccacagaagaaaacataggcaatgccattcaggacataggcatgggcaaagacttc

SEQ ID NO: 5085 - DNA, 92 bp, Homo Sapiens
agcaataaccaaacaacctcattaaaaagtaggcaaaggacataaacagacacttttcaaaagaagacatacacgtggccaacaaacatatg

SEQ ID NO: 5086 - DNA, 90 bp, Homo Sapiens
agaaagaatcaagaggaaatgcaagaaatccaaaacactgtaacagatatgatgaataatgaggtatgcactcatcagcagactcgacat

SEQ ID NO: 5087 - DNA, 75 bp, Homo Sapiens
gcactagtcagatcaagacagaaagtcaacgaacaaagaacagacttaaactacactctagaacaaatggaccta

SEQ ID NO: 5088 - DNA, 72 bp, Homo Sapiens
agcagccaacaagcatatgaaataatgctccacaacactcatcatcagagaaatgcaaatcaaaaccaaaat

SEQ ID NO: 5089 - DNA, 90 bp, Homo Sapiens
aatatacgcaaatcaataaatgtaatccagcatataaacagtactaaagacaaaaaccacatgattatctcaatagatgcagaaaaggcc

SEQ ID NO: 5090 - DNA, 92 bp, Homo Sapiens
atgtacacaaatcaataaatgcagtccagcatataaacagaaccaaacacaaaaaccacatgattatctcaatagatgcagaaaaggccttt

SEQ ID NO: 5091 - DNA, 84 bp, Homo Sapiens
tataccacacaaatgcaaaagattattagcaacaattatcaacagcaatatgtcaacaagttgacaaacctagaggacatggat

SEQ ID NO: 5092 - DNA, 85 bp, Homo Sapiens
aaacacacaaagcaacaaaagaacgaagcaacaaaagcatagatttattgaaatgaaagtacattctacagagtgggggcaggct

SEQ ID NO: 5093 - DNA, 72 bp, Homo Sapiens
gaaatcatcatcaaacggaatcgaatggaatcattgaatggaatggaatggaatcatcatggaatggaaacg

SEQ ID NO: 5094 - DNA, 90 bp, Homo Sapiens
aacagaatggaatcaaatcgaatgaaatggaatggaatagaaaggaatggaatgaaatggaatggaaaggattcgaatggaatgcaatcg

SEQ ID NO: 5095 - DNA, 102 bp, Homo Sapiens
tacaaagaactcaaacaaatcagcaagaacaaaaacaatcccaacaaaatgttggacaaagacatgaatagacaattctcgaaagaagatgtacaaatggct

SEQ ID NO: 5096 - DNA, 79 bp, Homo Sapiens
tgttgagagaaattaaacaaagcacagataaatggaaaaacgtgttcatagattgaaagacttcatgttgtatggtgtc

SEQ ID NO: 5097 - DNA, 124 bp, Homo Sapiens
aaacgattggacaggaatggaatcaccatcgaatggaaacgaatggaatcttcgaatggaattgaatgaaattattgaacggaatcaaatagaatcatcattgaacagaatcaaattggatcat

SEQ ID NO: 5098 - DNA, 85 bp, Homo Sapiens
aacaataaacaaactccaactagacacaatagtcaaattgctgaaaatgaaatataaaggaacaatctcgatggtagcccaagga

SEQ ID NO: 5099 - DNA, 84 bp, Homo Sapiens
aaatcaataaatgtaattcagcatataaacagaaccaaagacaaaaaccacatgattatctcaatagatgcagaaaaggccttt

SEQ ID NO: 5100 - DNA, 84 bp, Homo Sapiens
gctcaaggaaataaaataggacacaaagaaatggaaaaacattccatactcatggatagaaagaatcaatatcatgaaatggcc

SEQ ID NO: 5101 - DNA, 90 bp, Homo Sapiens
aacatacgcaaatcaataaatgtaatccagcatataaacagaaccaaagacaaaaaccacatgattatctcaatagatgcagaaaaggcc

SEQ ID NO: 5102 - DNA, 84 bp, Homo Sapiens
aacaatcactagtccttaagtaagagacaacaccttttgtcacacacagtttgtcctaactttatcttggtaattggggagacc

SEQ ID NO: 5103 - DNA, 54 bp, Homo Sapiens
agaaaacacacagacaacaaaaaacacagaacgacaatgacaaaatggccaagc

SEQ ID NO: 5104 - DNA, 87 bp, Homo Sapiens
acacaacaaccaagaaacaaccccattaagaagtgggaaaaatacatgaataaacacatctcaaaagaagacaaacaagtggctaac

SEQ ID NO: 5105 - DNA, 88 bp, Homo Sapiens
acagcagaaaacgaacatcagaaaatcactctacatgatgcttaaatacagagggcaagcaacccaagagaaaacaccacttcctaat

SEQ ID NO: 5106 - DNA, 90 bp, Homo Sapiens
gaatagaacagaatggaatcaaatcgaatgaaatggaatggaatagaaaggaatggaatgaaatggaatggaaaggattcgaatggaatg

SEQ ID NO: 5107 - DNA, 68 bp, Homo Sapiens
taagcagagaaaatatcaacacgaaaataatgcaaggagaaaaatacagaacaatccaaaatgtggcc

SEQ ID NO: 5108 - DNA, 84 bp, Homo Sapiens
gaacaatcaatggaagcagaaacaaataaaccaaggtgtgcatcaaggaatacattcacgcatgatggctgtatgagtaaaatg

SEQ ID NO: 5109 - DNA, 81 bp, Homo Sapiens
gatcaataaatgtaattcatcatataaacagagaactaaagacaaaaacacatgattatcgcaatacatgcagaaaaggcc

SEQ ID NO: 5110 - DNA, 91 bp, Homo Sapiens
gacaagagttcagaaaggaagactacacagaaatacgcattttaaagtcactgacatggagatgacacttaaaaccatgaacatggatggg

SEQ ID NO: 5111 - DNA, 91 bp, Homo Sapiens
aagcaaagaaagaatgaagcagcaaaagaacgaaagcaggaatttattgaaaaccaaagtacactccacagtatgggagcggacccgagca

SEQ ID NO: 5112 - DNA, 75 bp, Homo Sapiens
accaacataagacaaagaaacatccagcagctgcctatggcaaaagattacaatgtgtcaaacaagagggcaatg

SEQ ID NO: 5113 - DNA, 88 bp, Homo Sapiens
ggacaaattgctagaaataaacaaattaccaaaaatgattcaagtagagacagagaatcaaaatagaactacacataagtgggccaag

SEQ ID NO: 5114 - DNA, 75 bp, Homo Sapiens
aacataatccatcaaataaacagaaccaaagacaaaaaccacatgattatctcaatagatgcagaaaaggccttc

SEQ ID NO: 5115 - DNA, 96 bp, Homo Sapiens
aaaatcaatatgaaaacaaacacaagcagacaaagaaaattgggcaaaaggtttgagcagacacttcaccaaagaagtacaaatggcaaatcagca

SEQ ID NO: 5116 - DNA, 88 bp, Homo Sapiens
aaccaaattagacaaattggaaatcattacacataacaaaagtaataaactgtcagcctcagtagtattcattgtacataaactggcc

SEQ ID NO: 5117 - DNA, 105 bp, Homo Sapiens
aaggaatttaagcaaatcaacaagcaaaaccaaaataatcccattaaaaagtgggtaaaggacatgaatacacacttgtcaatagaggacattcaagtggccaac

SEQ ID NO: 5118 - DNA, 96 bp, Homo Sapiens
taacctgatttgccataatccacgatacgcttacaacagtgatatacaagttacatgagaaacacaaacattttgcaaggaaactgtggccagatg

SEQ ID NO: 5119 - DNA, 95 bp, Homo Sapiens
aactaacacaagaacagaaaaccaaacatcacatgttctcactcataagcgggagctgaacaatgagaacacacggacacagggagaggaacatg

SEQ ID NO: 5120 - DNA, 89 bp, Homo Sapiens
taaactgacacaaacacagacacacagatacacacatacatacagaaatacacattcacacacagacctggtctttggagccagagatg

SEQ ID NO: 5121 - DNA, 83 bp, Homo Sapiens
atcaacagacaacagaaacaaatccacaaagcacttagttattagaactgtcatacagactgtacaacaaccacatttaccat

SEQ ID NO: 5122 - DNA, 97 bp, Homo Sapiens
aaataagccaacggtcataaattgcaaagccttttacaatccaaacatgatggaaacgatatgccattttgaaggtgatttgaaaagcacatggttt

SEQ ID NO: 5123 - DNA, 99 bp, Homo Sapiens
aaacagttcaaaaattattgcaacaaaatgagagagatgagtttatcttgcaaactaatggatggtagcagtgacagtggcaaaacgtggtttgattct

SEQ ID NO: 5124 - DNA, 99 bp, Homo Sapiens
taagcaacttcagcaaagtctcaggatacaaaatcaatgtacaaaaatcacaagcattcttatacaccaacaacagacaaacaagagtgccaaatcatg

SEQ ID NO: 5125 - DNA, 133 bp, Homo Sapiens
agcaaacaaacaaacaaacaaacaaactatgacaggaacaaaacgtcacatatcaacattaacaaagaatgtaaacagcctaaatgcttcacttaaaagttatagacaggggctgggcatggtggctcacgcc

SEQ ID NO: 5126 - DNA, 84 bp, Homo Sapiens
ggaaataacagagaacacaaacaaatgggaaaacattccatgttcatggataggaagaatcaatattgtgaaaatggccatact

SEQ ID NO: 5127 - DNA, 88 bp, Homo Sapiens
agcaacttcagcaaagtctcaggatacaaaatcaatgtacaaaaatcacaagcattcttatacaccaataacagacaaacagagagcc

SEQ ID NO: 5128 - DNA, 84 bp, Homo Sapiens
agataagaataaggcaaacatagtaatagggagttcatgaataacacacggaaagagaacttacagggctgtgatcaggaaacg

SEQ ID NO: 5129 - DNA, 85 bp, Homo Sapiens
aggaaataaaagaagacacaaacaaatggaagaacattccatgcttatggatagggagaatcagtatcgtgaaaatggccatact

SEQ ID NO: 5130 - DNA, 93 bp, Homo Sapiens
aacatacgaaaatcaataaacgtaatccagcatataaacagaaccaaagacaaaaaccacatgattatctcaatagatgcagaaaaggccttt

SEQ ID NO: 5131 - DNA, 85 bp, Homo Sapiens
aatggactcgaatgaaatcatcatcaaacggaatcgaatggaatcattgaatggaatggaatggaatcatcatggaatggaaacg

SEQ ID NO: 5132 - DNA, 92 bp, Homo Sapiens
aagatttaaacataagacctaaaacgacaaaaatcctaggagaaaacctaagcaataccattcaggacataggcatgggcaaagacttcatg

SEQ ID NO: 5133 - DNA, 87 bp, Homo Sapiens
taatgagaagacacagacaacacaaagaatcacagaaacatgacacaggtgacaagaacaggcaaggacctgcagtgcacaggagcc

SEQ ID NO: 5134 - DNA, 80 bp, Homo Sapiens
taaacgttagacctaaaaccataaaaaccctagaagaaaacctaggcattaccattcaggacataggcatgggcaaggac

SEQ ID NO: 5135 - DNA, 75 bp, Homo Sapiens
gaattgaattgaatggaatggaatgcaatggaatctaatgaaacggaaaggaaaggaatggaatggaatggaatg

SEQ ID NO: 5136 - DNA, 69 bp, Homo Sapiens
gtaatggaatggaatggaaaggaatcgaaacgaaaggaatggagacagatggaatggaatggaacagag

SEQ ID NO: 5137 - DNA, 99 bp, Homo Sapiens
agagaaatgcaaatcaaaaccacaatggaataccatctcacgccagtcagaatggcaattattaaaaaatcacaacaattaatgatggcaaggctgtgg

SEQ ID NO: 5138 - DNA, 90 bp, Homo Sapiens
aacatacacaaatcaataaacgtaatccagcttataaacagaaccaaagacaaaaaccacatgattatctcaatagatgcggaaaaggcc

SEQ ID NO: 5139 - DNA, 56 bp, Homo Sapiens
taaacagaaccaaagacaaaaatcacatgattatctcaatagatgcagaaaaggcc

SEQ ID NO: 5140 - DNA, 76 bp, Homo Sapiens
aatggaatgcaatcgaatggaatggaatcgaacggaatggaataaaatggaagaaaactggcaagaaatggaatcg

SEQ ID NO: 5141 - DNA, 77 bp, Homo Sapiens
agataaaaagaacagcagccaaaatgacaaaagcaaaaagcaaaatcgtgttagagccaggtgtggtgatgtgtgct

SEQ ID NO: 5142 - DNA, 81 bp, Homo Sapiens
aggaaagttttcaatatgagaaagatacaaaccaacagaataagcaaactggataaacagaaaatacagagagagccaagg

SEQ ID NO: 5143 - DNA, 82 bp, Homo Sapiens
gcaatctcaggatacaaaatcaatgtgcaaaaatcacaagcattctcatacaccaataacagacaaacagagccaaatcatg

SEQ ID NO: 5144 - DNA, 103 bp, Homo Sapiens
agcattcatatcttgcagtgttgggaaagagtgagaggttgtgatgtcaagaaggataggtcagaagtggaaggtatgggggattgtgcctgctgtcatggct

SEQ ID NO: 5145 - DNA, 88 bp, Homo Sapiens
agcaacttcagcaaagtctcaggatacaaaatcaatgtgcaaaaatcacaagcattcttatacaccaataacagacaaacagagagcc

SEQ ID NO: 5146 - DNA, 88 bp, Homo Sapiens
agcaacttcagcaaagtctcaggatacaaaatcaatgtgcaaaaatcacaagcattcttatacaccaacaacagacaaacagagagcc

SEQ ID NO: 5147 - DNA, 107 bp, Homo Sapiens
taagccgataagcaacttcagcaaagtctcaggagacaaaatcaatgtgcaaaaaatcacaagcattcttatacactaataacagacaaacagagagccaaatcatg

SEQ ID NO: 5148 - DNA, 74 bp, Homo Sapiens
aacgtgacatacatacaaaaagtttttagagcaagtgaaattttagctgctatatgttaattggtggtaatccc

SEQ ID NO: 5149 - DNA, 86 bp, Homo Sapiens
tacgcaaatcgataaatgtaatccagcatataaacagaaccaaagacaaaaaccacatgattatctcaatagatgcagaaaaggcc

SEQ ID NO: 5150 - DNA, 68 bp, Homo Sapiens
gcaatcgaatggaatggaatcgaacggaatggaataaaatggaagaaaactggcaagaaatggaatcg

SEQ ID NO: 5151 - DNA, 72 bp, Homo Sapiens
ttgaatcgaatggaatcgaatggattggaaaggaatagaatggaatggaatggaattgactcaaatggaatg

SEQ ID NO: 5152 - DNA, 90 bp, Homo Sapiens
taaagaaaaacaaacaaacagaaatcaatgaaaatcccattcaaaggtcagcaacctcaaagactgaaggtagataagcccacaaggatg

SEQ ID NO: 5153 - DNA, 77 bp, Homo Sapiens
gtcatatttgggatttatcatctgtttctattgttgttgttttagtacacacaaagccacaataaatattctaggct

SEQ ID NO: 5154 - DNA, 77 bp, Homo Sapiens
aaaagtacagaagacaacaaaaaatgagagagagaaagataacagactatagcagcattggtgatcagagccaccag

SEQ ID NO: 5155 - DNA, 87 bp, Homo Sapiens
aacccacaaagacaacagaagaaaagacaacagtagacaaggatgtcaaccacattttggaagagacaagtaatcaaacacatggca

SEQ ID NO: 5156 - DNA, 105 bp, Homo Sapiens
aaagaccgaaacaacaacagaaacagaaacaaacaacaataagaaaaaatgttaagcaaaacaaatgattgcacaacttacatgattactgagtgttctaatggt

SEQ ID NO: 5157 - DNA, 80 bp, Homo Sapiens
aatcagtaaacgtaatacagcatataaacagaaccaaagacaaaaaccacatgattatctcaatagatgcagaaaaggcc

SEQ ID NO: 5158 - DNA, 97 bp, Homo Sapiens
aagcaacttcagcaaagtctcaggacacaaaatcaatatgcgaaaatcacaagcattcctatacaccaataatagacaaacagagagccaaatcatg

SEQ ID NO: 5159 - DNA, 88 bp, Homo Sapiens
agcaacttcagcaaaatctcaggatacaaaatcaatgtacaaaaatcacaagcattcttatacaccaacaacagacaaacagagagcc

SEQ ID NO: 5160 - DNA, 104 bp, Homo Sapiens
taatgcaaactaaaacgacaatgagatatcaatacataactaccagaaaggctaacaaaaaaacagtcataacacaccaaaggctgatgagtgaggatgtgcag

SEQ ID NO: 5161 - DNA, 88 bp, Homo Sapiens
agcaacttcagcaaagtctcaggatacaaaatcgatgtgcaaaaatcacaagcattcttatacaccaataacaggcaaacagagagcc

SEQ ID NO: 5162 - DNA, 93 bp, Homo Sapiens
gatatataaacaagaaaacaactaatcacaactcaatatcaaagtgcaatgatggtgcaaaatgcaagtatggtggggacagagaaaggatgc

SEQ ID NO: 5163 - DNA, 74 bp, Homo Sapiens
aagacagaacactgaaactcaacagagaagtaacaagaacacctaagacaaggaaggagagggaaggcaggcag

SEQ ID NO: 5164 - DNA, 75 bp, Homo Sapiens
taagacacatagaaaacataaagcaaaatggcagatgtaaatgcaacctatcaatcaaaacattacgaatggctt

SEQ ID NO: 5165 - DNA, 95 bp, Homo Sapiens
tgaaacaaatgataatgaaaatacaacataccaaacatacgagatacagtaaaagcagtactaagatgcaagtatatattgctacaagtgcctac

SEQ ID NO: 5166 - DNA, 135 bp, Homo Sapiens
aatgtaatccagcatataaacagagccaaagacaaaaaccacatgattatctcaatagatgcagaaaaagcctttgacaaaattcaacaacccttcatgctaaaaactctcaataaattaggtattgatgggacg

SEQ ID NO: 5167 - DNA, 87 bp, Homo Sapiens
acaaaattgatagaccactagcaagactaataaagaagaaaagagagaagaatcattaccattcaggacataggcatgggcaaggac

SEQ ID NO: 5168 - DNA, 85 bp, Homo Sapiens
aaggattcgaatggaatgcaatcgaatggaatggaatcgaacggaatggaataaaatggaagaaaactggcaagaaatggaatcg

SEQ ID NO: 5169 - DNA, 75 bp, Homo Sapiens
gatcatcagagaaacagagaaatgcaaattaaaaccacaatgagatactatctccacacaagtcagaatggctat

SEQ ID NO: 5170 - DNA, 95 bp, Homo Sapiens
atcaaaagaaaagcaacctaacaaatacgggaagaatatttgaatagacatttcacaggaaaagatatatgaatggccaaaaagcaaatgaaaag

SEQ ID NO: 5171 - DNA, 58 bp, Homo Sapiens
aacagcaatgacaatgatcagtaacaacaagacttttaactttgaaaaaatcaggacc

SEQ ID NO: 5172 - DNA, 91 bp, Homo Sapiens
aagagcctgaatagctaaagtgatcataagcaaaaagaacaaagtcggaagcatcacattacctgacttcaaactatactcaaaggctatg

SEQ ID NO: 5173 - DNA, 101 bp, Homo Sapiens
actcaggaaaaataacgaatccaactcacaggagaaagaagtacaaaccagaaaccaatttcaaattacaaggaccagaatactcatgttggctggccagt

SEQ ID NO: 5174 - DNA, 78 bp, Homo Sapiens
ttgaccagaacacattacacaatgctaatcaactgcaaaggagaatatgaacagagaggaggacatggatattttgtg

SEQ ID NO: 5175 - DNA, 92 bp, Homo Sapiens
aacatatggaaaaaaactcaacatcactgatcattagagaaatgcaaatcaaaaccacaatgagataccatctcacgccagtcagaatggcg

SEQ ID NO: 5176 - DNA, 88 bp, Homo Sapiens
agcaacttcagcaaagactcaggatacaaaatcaatgtgcaaaaatcacaagcattcttatacaccaataacagacagagagccaaat

SEQ ID NO: 5177 - DNA, 84 bp, Homo Sapiens
tgggatatgggtgaaagaacaagtttgcagaaaagatacagtgaattatggaccatgagttcgggaaagaagggtaggactgcg

SEQ ID NO: 5178 - DNA, 79 bp, Homo Sapiens
agcagtgcaagaacaacataacatacaagtaaacaaacacatggggccaggtaataaaaagtcaggctcaagaggtcag

SEQ ID NO: 5179 - DNA, 91 bp, Homo Sapiens
aaggaaaagtaaaaggaacttaacaccttcaagaaaagacagacaaataacaaaacagcagtttgatagaatgagatatcaggggatggca

SEQ ID NO: 5180 - DNA, 96 bp, Homo Sapiens
gctagttcaacatatgcaaatcaataaacgtaatccatcacataaacagaaccaatgacaaaaaccacgattatctcaatagatgcagaaaaggcc

SEQ ID NO: 5181 - DNA, 76 bp, Homo Sapiens
aacatcactgatcattagaaacacacaaatcaaaaccacaataagataccatctaacaccagtcacaatggctatt

SEQ ID NO: 5182 - DNA, 80 bp, Homo Sapiens
agagcatccacaaggcccaattcaaagaatctgaaataatgtattgttactgcaacagttgtgagtaccagtggcatcag

SEQ ID NO: 5183 - DNA, 70 bp, Homo Sapiens
ggaataacaacaacaacaaccaaaagacatatagaaaacaaacagcacgatggcagatgtaaagcctacc

SEQ ID NO: 5184 - DNA, 103 bp, Homo Sapiens
aaacgcagaaacaaatcaacgaaagaacgaagcaatgaaagacaaagcaacaaaagaatggagtaagaaagcacactccacaaagtggaagcaggctgggaca

SEQ ID NO: 5185 - DNA, 88 bp, Homo Sapiens
agcaacttcagcaaagtctcaggatacaaaatcaatgtgcaaaaatcacaagcattcctatacaccaacaacagacaaacagagagcc

SEQ ID NO: 5186 - DNA, 88 bp, Homo Sapiens
agcaacttcagcaaagtctcaggatacaaaatcaatgggaaaaaatcacaagcattcctatacatcaataacagacaaacagagagcc

SEQ ID NO: 5187 - DNA, 88 bp, Homo Sapiens
acacatttcaaggaaggaaacaagaacagacagaaacacaacatacttcatgaaaccacattttagcatcctggccgagtattcatca

SEQ ID NO: 5188 - DNA, 88 bp, Homo Sapiens
agcaacttcagcaaagtctcaggacacaaaatcaatgtgcaaaaatcacaagcattcttatacaccaataacagacaaacagagagcc

SEQ ID NO: 5189 - DNA, 109 bp, Homo Sapiens
tattttaccagattattcaagcaatatatagacagcttaaagcatacaagaagacatgtatagatttacatgcaaacactgcaccactttacataagggacttgagcac

SEQ ID NO: 5190 - DNA, 89 bp, Homo Sapiens
cccaacttcaaattatactacaaggctacagtaatcaaaaaagcatagtactattacaaaaacagacacacaggccaatggaatacaat

SEQ ID NO: 5191 - DNA, 96 bp, Homo Sapiens
agaaaggattcgaatggaatgaaaaagaattgaatggaatagaacagaatggaatcaaatcgaatgaaatggaatggaatagaaaggaatggaatg

SEQ ID NO: 5192 - DNA, 86 bp, Homo Sapiens
gtttacagtcaagtgtacaaacagaatataagcaaacaaaagagaacatatacttacaaactatgctaagtgccatgaaggaaaag

SEQ ID NO: 5193 - DNA, 92 bp, Homo Sapiens
aagagtattgaagttgacatatctagactgatcaagaacaaagacaaaaggtacagattatcaagaaaatgagcgggcaaagcaagatggcc

SEQ ID NO: 5194 - DNA, 102 bp, Homo Sapiens
agtagaattgcaattgcaaatttcacacatatactcacacacaagtacacacatccacttttacaactaaaaaaactagcacccaggacaggtgcagtggct

SEQ ID NO: 5195 - DNA, 147 bp, Homo Sapiens
tgaatgctatagagcagtaaaaacaaataaatgaactacattacagctacttacaaccatatgaaagaatataaccataacaatgatgagtggacaaaagctaagtgtgaaagaatgcatagtgctacagcagccaacatttacagc

SEQ ID NO: 5196 - DNA, 74 bp, Homo Sapiens
gaatggaatcaaatagaatggaatcgaaacaaatggaatggaatggaatgggagctgagattgtgtcactgcac

SEQ ID NO: 5197 - DNA, 86 bp, Homo Sapiens
taaaagtgtgctcaacatcattgatcatcagagaaatgcaaatcaaaactacaatgagatatcatctcatcccagtcaaagtggct

SEQ ID NO: 5198 - DNA, 61 bp, Homo Sapiens
tcagaccatagcagataacatgcacattagcaatacgattgccatgacagagtggttggtg

SEQ ID NO: 5199 - DNA, 62 bp, Homo Sapiens
acaaacaatccaattcgaaaatgggcaagatatttcaccaaagacatgagctgatatttcac

SEQ ID NO: 5200 - DNA, 98 bp, Homo Sapiens
aggaaaaacaacaacaacaacaggaaaacaacctcagtatgaagacaagtacattgatttattcaacatttactgatcacttttcaggtggtaggcag

SEQ ID NO: 5201 - DNA, 106 bp, Homo Sapiens
aacaaaacaaaaacccaactcaataacaagaagacaaacaacccaatttaaaatgagcaaagaacttgataaacatgtctccaaagaagatacggccaaagagcac

SEQ ID NO: 5202 - DNA, 90 bp, Homo Sapiens
atacaactaaagcaaatataagcaactaaagcaacagtacaactaaagcaaaacagaacaagactgccagggcctagaaaagccaagaac

SEQ ID NO: 5203 - DNA, 95 bp, Homo Sapiens
aacaacaacaacaacaggaaaacaacctcagtatgaagacaagtacattgatttattcaacatttactgatcacttttcaggtggtaggcagacc

SEQ ID NO: 5204 - DNA, 86 bp, Homo Sapiens
agagagtattcatcatgaggagtattactggacaaataattcacaaacgaacaaaccaaagcgatcatctttgtactggctggcta

SEQ ID NO: 5205 - DNA, 69 bp, Homo Sapiens
agtaaatcaccataaagaaggtaagagttcattcacaaaaacaacaaactgaagaatcaggccatagta

SEQ ID NO: 5206 - DNA, 86 bp, Homo Sapiens
aaaatagaatgaaagagaatcaaatggaattgaatcgaatggaatcgaatggattggaaaggaatagaatggaatggaatggaatg

SEQ ID NO: 5207 - DNA, 79 bp, Homo Sapiens
aaaagatgcaaaagtagcaaatgcaatgttaaaacaagcaaagaaagaatcaggtggaccacatagtgcagtgcttctc

SEQ ID NO: 5208 - DNA, 62 bp, Homo Sapiens
ttcacagcagcattacgcacaatagccagaaggtgggaacagacaaaatgccttttgatggg

SEQ ID NO: 5209 - DNA, 74 bp, Homo Sapiens
ccataacacaattaaaaacaacctaaatgtctaatagaagaacactgttcagaccgggcatggtggcttatacc

SEQ ID NO: 5210 - DNA, 88 bp, Homo Sapiens
tggatttcagatatttaacacaaaatagtcaaagcagataaatactagcaacttatttttaatgggtaacatcatatgttcgtgcctt

SEQ ID NO: 5211 - DNA, 138 bp, Homo Sapiens
atcattgaatgcaatcacatggaatcatcacagaatggaatcgtacggaatcatcatcgaatggaattgaatggaatcatcaattggactcgaatggaaacatcaaatggaatcgattggaagtgtcgaatggactcg

SEQ ID NO: 5212 - DNA, 99 bp, Homo Sapiens
agaaacagccagaaaacaattattacctacagcattaaaactattcaaatgacagcatatttttcagcagaaatcatgaaggccagaaggacgtgtcat

SEQ ID NO: 5213 - DNA, 87 bp, Homo Sapiens
aaaatgatcatgagaaaattcagcaacaaaaccatgaaattgcaaagatattacttttgggatggaacagagctggaaggcaaagag

SEQ ID NO: 5214 - DNA, 76 bp, Homo Sapiens
aaccactgctcaaggaaataagagagaacacaaacaaatgaaaaaacattccatgctcatggataggaagaatcag

SEQ ID NO: 5215 - DNA, 77 bp, Homo Sapiens
tactctcagaagggaagcagatattcagcataaatcatattgtttgtacaaagagtctgggcatggtgaatgacact

SEQ ID NO: 5216 - DNA, 109 bp, Homo Sapiens
tatagttgaatgaacacacatacacacacacatgccacaaaacaaaaacaaagttatcctcacacacaggatagaaaccaaaccaaatcccaacacatggcaagatgat

SEQ ID NO: 5217 - DNA, 95 bp, Homo Sapiens
gctcaaagaaatcagaaatgacacaagcaaatggaaaaacatgccatgttcatgaatatgaagaatcaatattgttaaaatggccatactgctca

SEQ ID NO: 5218 - DNA, 67 bp, Homo Sapiens
ggatacaaaatcaatgtacaaaaatcacaagcattcttatacaccaataacagacaaacagagagcc

SEQ ID NO: 5219 - DNA, 88 bp, Homo Sapiens
agcaacttcagcaaagtctcaggatacaaaatcaatgtacaaaaatcacaagcattcttatacaccaacaacagacaaacagagagcc

SEQ ID NO: 5220 - DNA, 83 bp, Homo Sapiens
aggagaatagcagtagaatgacaaaattagattttcacatgaaacttgatgacagtgtaggaaatggactgaaaggacaagac

SEQ ID NO: 5221 - DNA, 88 bp, Homo Sapiens
agcaacttcagcaaagtctcgggatacaaaatcaatgtgcaaaaatcacaagcattcctatacaccaataacaggcaaacagagagcc

SEQ ID NO: 5222 - DNA, 129 bp, Homo Sapiens
aagttcaaacatcagtattaaccttgaacatcaatggcctacatgcatcacttaaaacatacagacaggcaaattgggttaagaaaacaaacaagcaaacaaaacatgttccaaacatttgttggctat

SEQ ID NO: 5223 - DNA, 95 bp, Homo Sapiens
aagaaacaatcaaaaggaagtgctagaaataaaacacactgtaatagaaaagaagaatgccttatgggcttatcaatagactagacatggccagg

SEQ ID NO: 5224 - DNA, 139 bp, Homo Sapiens
aaagaaagacagagaacaaacgtaattcaagatgactgattacatatccaagaacattagatggtcaaagactttaagaaggaatacattcaaaggcaaaaagtcacttactgattttggtggagtttgccacatggac

SEQ ID NO: 5225 - DNA, 88 bp, Homo Sapiens
agcaacttcagcaaagtttcaggatacaaaatcaatgtgcaaaaatcacaagcattcttatacaccaacaacagacaaacagagagcc

SEQ ID NO: 5226 - DNA, 71 bp, Homo Sapiens
agaatcaaatggaattgaatcgaatggaatcgaatggattggaaaggaatagaatggaatggaatggaatg

SEQ ID NO: 5227 - DNA, 106 bp, Homo Sapiens
aaacagaaccacagatatctgtaaaggattacactatagtattcaacagagtatggaacagagtatagtattcaacagagtatgcaaagaaactaaggccagaaag

SEQ ID NO: 5228 - DNA, 83 bp, Homo Sapiens
aaaaaatgttcaacatcactagtcagcagagaaatgcaaatcaaaatcacaatgagataacttctcacaccagacagcatggc

SEQ ID NO: 5229 - DNA, 87 bp, Homo Sapiens
gaatccatgttcatagcacaacaaccaaacagaagaaatcactgtgaaataagaaacaaagcaaaacacagatgtcgacacatggca

SEQ ID NO: 5230 - DNA, 68 bp, Homo Sapiens
aggatacaaaatcaaagtgcaaaaatcacaagcattcttatacaccaataacagacaaacagagagcc

SEQ ID NO: 5231 - DNA, 101 bp, Homo Sapiens
aacagatttaaacaaaccaacaagcaaaaaacgaacaactccattcaaacatggacaaaagacacgaacagacacttttcaaagaagacatacatgtggcc

SEQ ID NO: 5232 - DNA, 87 bp, Homo Sapiens
aaagacaatatacaaatggccaataagcacatgaaaagacgctcaacatccttagtcgttaaggcaatgcaaatcaaaaccacaatg

SEQ ID NO: 5233 - DNA, 82 bp, Homo Sapiens
taaacaacgagaacacatgaacacaaagaggggaacaacagacaccaagaccttcttgagggtggaggatgggaggagggag

SEQ ID NO: 5234 - DNA, 92 bp, Homo Sapiens
ggttcaacttacaatattttgacttgacaacagtgcaaaagcaatacacgattagtagaaacacacttccaatgcccataggaccattctgc

SEQ ID NO: 5235 - DNA, 88 bp, Homo Sapiens
agcaacttcagcaaagtctcaggatacaaaatcaatgagcaaaaatcacaagcattcttacacaccaataacagacaaacagagagcc

SEQ ID NO: 5236 - DNA, 67 bp, Homo Sapiens
aatccagcatataaacagaaccaaagacaaaaaccacatgattatctcaatagatgcagaaaaggcc

SEQ ID NO: 5237 - DNA, 95 bp, Homo Sapiens
tgaaaatacaaatgaccatgcaagtaattccgcagggagagagcggatatgaacaaacagaagaaatcagatgggatagtgctggcgggaagtca

SEQ ID NO: 5238 - DNA, 67 bp, Homo Sapiens
gcaaatgattataagtgctgttatagaaacattcaaagaccagaaaaggaccacaatggctgaccac

SEQ ID NO: 5239 - DNA, 90 bp, Homo Sapiens
agtcaataacaagaagacaaacaacccaattacaaaatgggatatgaatttaatagatgttactccaaggaagatacacaaatggccaac

SEQ ID NO: 5240 - DNA, 83 bp, Homo Sapiens
atggttaaaactcaacaatgaaaacacaaacagcgcaatttaaaaatgggcaaaatgacaggccagacccagtggctcatgcg

SEQ ID NO: 5241 - DNA, 102 bp, Homo Sapiens
taactactcacagaactcaacaaaacactatacatgcatttaccagtttattataaagatacaagtcaggaacagccaaatggaagaaatgtaaatggcaag

SEQ ID NO: 5242 - DNA, 98 bp, Homo Sapiens
aacagaccataaataaacacagaagacacacgagtgtaaagtcagtgccccgctgcgaattaaatcggggtgatgtgatggcgagtgagtgggtagtt

SEQ ID NO: 5243 - DNA, 69 bp, Homo Sapiens
gaatagaatagaatggaatcatcgaatggaatcgaatggaatcatcatgatatggaattgagtggaatc

SEQ ID NO: 5244 - DNA, 81 bp, Homo Sapiens
ggaatctataatacagctgtttatagccaagcactaaatcatatgatacagaaaacaaatgcagatggtttgaagggtggg

SEQ ID NO: 5245 - DNA, 90 bp, Homo Sapiens
aagatagagttgaaacagtggacaattaaagagtaatttggaagaatggtgaaattacagccatgctttgaatcaggcgggttcactggc

SEQ ID NO: 5246 - DNA, 80 bp, Homo Sapiens
tgaaaagaagaatgaccataagcaagcagatgaaaaacaaaacagaatttttacagacgtcttggactgatatcttgggc

SEQ ID NO: 5247 - DNA, 82 bp, Homo Sapiens
aggaatctataatacagctgtttatagccaagcactaaatcatatgatacagaaaacaaatgcagatggtttgaagggtggg

SEQ ID NO: 5248 - DNA, 84 bp, Homo Sapiens
aggaaaagaaagaaatagaaaatgcgaaatggtaagaaaaaacagcataataaacatttgtatggtgttgatggacaatgcatt

SEQ ID NO: 5249 - DNA, 122 bp, Homo Sapiens
taacagtaccaaaaaacagtcataatcttcaagagcttaaatttagcatgaaaggaagacattcatcaaagaatcacacaaaggaatgtaaaattaaatggagattagtgccaggaaagagc

SEQ ID NO: 5250 - DNA, 82 bp, Homo Sapiens
gcaaaacacaaacaacgccataaaaaactgggcaaaggatatgaacagacatttttcaaaacaaaacatacttatggccaac

SEQ ID NO: 5251 - DNA, 100 bp, Homo Sapiens
aacaaaattgaacaacatgcaaagaaacataaacgaagcaatgaaagtgtgcagatccactgaaatgaaagtgctgtccagagtgggagccagctcgaga

SEQ ID NO: 5252 - DNA, 113 bp, Homo Sapiens
gaatggaatcaacatcaaacggaatcaaacggaattatcgaatggaatcgaagagaatcatcgaatggccacgaatggaatcatctaatggaatggaatggaataatccatgg

SEQ ID NO: 5253 - DNA, 137 bp, Homo Sapiens
tacaagaaaatcacagtaacatttataaaacacagaagtgtgaacacacagctattgaccttgaaaacagtgaaagagggtcagctgtagaactaagacataagcaaagtttttcaatcaagaatacatgggtggcc

SEQ ID NO: 5254 - DNA, 87 bp, Homo Sapiens
aagaattggacaaaacacacaaacaaagcaaggaaggaatgaaaggatttgttgaaaatgaaagtacactccacagtgtgggagcag

SEQ ID NO: 5255 - DNA, 92 bp, Homo Sapiens
acagttaacaaaaaccgaacaatctaattacgaaatgaacaaaagatatgaacagacatttcacccgagagtatacaggggccaggcatggt

SEQ ID NO: 5256 - DNA, 83 bp, Homo Sapiens
aaacgcacaaacaaagcaaggaaagaatgaagcaacaaaagcagagatttattgaaaatgaaaaatacactccacagggtggg

SEQ ID NO: 5257 - DNA, 86 bp, Homo Sapiens
caccatgagtcattaggtaaatgcaaatcaaaaccacaatgaaatacttcacacccatgaagatggctataataaaaaaacagaca

SEQ ID NO: 5258 - DNA, 88 bp, Homo Sapiens
agcaacttcagcaaagtctcaggagacaaaatcaatgtacaaaaatcacaagcattcttatacaccaataacagacaaacagagagcc

SEQ ID NO: 5259 - DNA, 97 bp, Homo Sapiens
tgacatgcaagaaataaggaagtgcaaaaacaaacaaacaaacaacaacaacaacaacaacaacaacaacaaaaaacagtcccaaaaggatgggcag

SEQ ID NO: 5260 - DNA, 80 bp, Homo Sapiens
agacttgaaaagcacagacaacgaaagcaaaaatggacaaatggaatcacatcaagctaaaaggttttgcatggcaaagg

SEQ ID NO: 5261 - DNA, 83 bp, Homo Sapiens
gcaaaagaaacaatcagtagagtaaacagacaactcatagaatgcaagaaaatcatcgcaatctgtacatccaacaaagggct

SEQ ID NO: 5262 - DNA, 86 bp, Homo Sapiens
acaaaatcaaactaacctcgataagaatgcaagtgaatcaaaatgagtttcaaggggttgtggctagtacacgctttctacagctg

SEQ ID NO: 5263 - DNA, 96 bp, Homo Sapiens
acaaaccactgctcaaggaaataaggacacaaacaaatggaacaacattccgtgctcatggataggaagaatcaatatcgtgaaaatggccatact

SEQ ID NO: 5264 - DNA, 86 bp, Homo Sapiens
gaacgatttatcactgaaaattaatactcatgcaagtagtaaacgaatgtaatgaccatgataaggagacggacggtggtgatagt

SEQ ID NO: 5265 - DNA, 73 bp, Homo Sapiens
agcagaagaaataactgaaatcagagtgaaactgaatcaaattgagatgcaaaaatacatacgaaatggccag

SEQ ID NO: 5266 - DNA, 91 bp, Homo Sapiens
tgaatagacacacagaccaatggaacagaatagagaacacagaataaatctgcacacttatagccagctgatttttgacaaatttgccaag

SEQ ID NO: 5267 - DNA, 86 bp, Homo Sapiens
agcaacttcagcagtctcagtatacaaaaacaatgtgcaaaaatcacaagcattcctatatgccaataacagacaaacagagagcc

SEQ ID NO: 5268 - DNA, 61 bp, Homo Sapiens
accaatcaagaaaacaatgcaacccacagagaatggacaaaagcaaggcaggacaatggct

SEQ ID NO: 5269 - DNA, 89 bp, Homo Sapiens
gccacaattttgaaacaaccataataatgagaatacacaagacaactccaataatgtgggaagacaaactttgcaattcacatcatggc

SEQ ID NO: 5270 - DNA, 82 bp, Homo Sapiens
gaaaatgaacaatatgaacaaacaaacaaaattactacccttacgaaagtacgtgcattctagtatggtgacaaaaaggaaa

SEQ ID NO: 5271 - DNA, 85 bp, Homo Sapiens
tatgcaaatcaataaacataatccatcacataaacagaaacaaagacaaaatgacatgattatctcaatagatgcagaaaaggcc

SEQ ID NO: 5272 - DNA, 133 bp, Homo Sapiens
cacccatctgtaggaccaggaagcctgatgtgggagagaacagcaggctaaatccagggttggtctctacagcagagggaatcacaagcctgttagcaagtgaagaaccaacactggcaagagtgtgaaggcc

SEQ ID NO: 5273 - DNA, 80 bp, Homo Sapiens
aggatacaaaatcaatgtacaaaaatcacaaacattcttatacaccaacaacagacaaacagagagccaaatcatgggtg

SEQ ID NO: 5274 - DNA, 96 bp, Homo Sapiens
aggaaaatgcaaatcagaacgactataacacaccatctcaaactcgttaggatggctattatcaaaaagtcaagagataacaaatgtgggcaaggg

SEQ ID NO: 5275 - DNA, 91 bp, Homo Sapiens
gtaacaaaacagactcatagaccaatagaacagaatagagaattcagaaataagactgcacttctatgaccatgtgatcttagacaaacct

SEQ ID NO: 5276 - DNA, 91 bp, Homo Sapiens
aaaggaaaactacaaaacactgctgaaagaaatcattgacaacacaaacaaatggaaacacatcccaagatcatgggtgggtggaatcaat

SEQ ID NO: 5277 - DNA, 121 bp, Homo Sapiens
acacacataccaacagaacatgacaaaagaacaaaaccagccgcatgcatactcgatggagacaaaggtaacactgcagaatggtgaaggaagaacagtcattttaatgacagtgttggct

SEQ ID NO: 5278 - DNA, 95 bp, Homo Sapiens
aactaagacaacagattgatttacactactattttcacacagccaaaaatatcactatggcaatcgtcaaaaggtcaattcaaagatgggacagt

SEQ ID NO: 5279 - DNA, 113 bp, Homo Sapiens
gatcagcttagaatacaatggaacagaacagattagaacaatgtgattttattaggggccacagcactgttgactcaagtacaagttctgactcatgtagaactaacactttt

SEQ ID NO: 5280 - DNA, 74 bp, Homo Sapiens
gaatggaatcaaatcgaatgaaatggaatggaatagaaaggaatggaatgaaatggaatggaaaggattcgaat

SEQ ID NO: 5281 - DNA, 86 bp, Homo Sapiens
aaatgaacaaaactagaggaatgacattacctgacttcaaattatactacagagctatagtaaccaaaacagcatggtacaggcat

SEQ ID NO: 5282 - DNA, 91 bp, Homo Sapiens
ggacaacatacacaaatcagtcaagatacatcatttcaacagaatgaaagacaaaaaccatttgatcacttcaatcgatgatgaaaaagca

SEQ ID NO: 5283 - DNA, 85 bp, Homo Sapiens
aacttcagcaaattctcaggatacaaaatcaatgtgcaaaaaccacaagcattcctatacaccaataatagacagtgagccaaat

SEQ ID NO: 5284 - DNA, 79 bp, Homo Sapiens
tatgactttcacaaattacagaaaaagacacccatttgacaagggaactgaaggtggtgaagacatactggcaggctac

SEQ ID NO: 5285 - DNA, 70 bp, Homo Sapiens
aacagcaatagacacaaagtcagcacttacagtacaaaaactaatggcaaaagcacatgaagtgggacat

SEQ ID NO: 5286 - DNA, 76 bp, Homo Sapiens
tgtaacactgcaaaccataaaaaccgtagaagaaaacctagacaatactattcaggacataggcatgggcaaagac

SEQ ID NO: 5287 - DNA, 83 bp, Homo Sapiens
gaagaagaaaaaacatggatatacaatgtcaacagaaatcaaggagaaacggaatttcaccaatcaatttagtgatctgggtt

SEQ ID NO: 5288 - DNA, 106 bp, Homo Sapiens
aaaacacacaaacatacatgtggatgcacatataaacatgcacatacacacacacataaatgcacaaacacacttaacacaagcacacatgcaaacaaacacatgg

SEQ ID NO: 5289 - DNA, 83 bp, Homo Sapiens
tagaaggaatttgatacatgctcagaaatacaggcaaaggaagtaggtgcctgccagtgaacacaggggaactatggctccta

SEQ ID NO: 5290 - DNA, 131 bp, Homo Sapiens
tgactaaacagagttgaacaagaacaaaaagcaaatttgcagaaatgaaatacatactaattgaaagtccatggacaggctcaacagatgatatagatacagctaaagagataattagtgaaatggatcag

SEQ ID NO: 5291 - DNA, 101 bp, Homo Sapiens
aagtaataagactgaattagtaatacaaagtgtctcaacaaagaaaattgcgggactgttcatgctcatggacaggaagaatcaatatcatgaaaatggcc

SEQ ID NO: 5292 - DNA, 106 bp, Homo Sapiens
acagacagagatttaaaacaataaacaagcagtaagcaaacacagataacaaaatgacatgatccaacaaatactcagaaggagacttagaaatgaattgagggtc

SEQ ID NO: 5293 - DNA, 85 bp, Homo Sapiens
agaaaaaaacaaacagcccattaaaaggtagacaaaggacatgaacacttttcaaaagaagacatacatgtggccaaacagcatg

SEQ ID NO: 5294 - DNA, 79 bp, Homo Sapiens
aaaaatgaccagagcaatagaatgcattgaccagataaagaccttcacgtatgttgaactaaaatgtgtggtgcaggtg

SEQ ID NO: 5295 - DNA, 81 bp, Homo Sapiens
aatcagtctagatcttaaaggaacaccagagggagtatttaaatgtgcccaataagcaagaattatggtgatgtggaagta

SEQ ID NO: 5296 - DNA, 71 bp, Homo Sapiens
gaatggaatggaaaggaatcgaaacgaaaggaatggagacagatggaatggaatggaacagagagcaatgg

SEQ ID NO: 5297 - DNA, 107 bp, Homo Sapiens
ggaatggaatgaacacgaatgtaatgcaacccaatagaatggaatcgaatggcatggaatataaagaaatggaatcgaagagaatggaaacaaatggaatggaattg

SEQ ID NO: 5298 - DNA, 98 bp, Homo Sapiens
aggacatgaatagacaattctcaaaagaagatacacaagtggcaaacaaacacatgaaaaaagactcaacattagtaatgaccatggaaatgcaaatc

SEQ ID NO: 5299 - DNA, 92 bp, Homo Sapiens
tccagtcgatcatcatatagtcagcacttatcatacaccaagccgtgtgcaaggaaagggaatacaaccatgaacatgatagatggatggtt

SEQ ID NO: 5300 - DNA, 91 bp, Homo Sapiens
tacagataagaaaattgagactcaagagtattacataaattgtttcagctaccacagcaaaaaatggtatggttgggaatcaagctcaggg

SEQ ID NO: 5301 - DNA, 113 bp, Homo Sapiens
agcctatcaaaaagtgggctaagaatatgaatacacaattctcaaaagaagatatacaaatgggcaacaaacatatgaaaacatactcaacatcactaatgatcagggaaatg

SEQ ID NO: 5302 - DNA, 83 bp, Homo Sapiens
gaaaatgaacaatatgaacaaacaaacaaaattactacccttacgaaagtacgtgcattctagtatggtgacaaaaaggaaag

SEQ ID NO: 5303 - DNA, 95 bp, Homo Sapiens
acatacgcaaatcaataaacataatccatcacataaacagaaccaaagacaaaaatcacatgattatctcaatagatgcagaaaaggccttcgac

SEQ ID NO: 5304 - DNA, 77 bp, Homo Sapiens
aagagtatcaacagtaaattacattagcagaagaatcaacaaacatgaaaatagaaattatggtagccaaagaacag

SEQ ID NO: 5305 - DNA, 75 bp, Homo Sapiens
aatcgaatggaatcaacatcaaacggaaaaaaacggaattatcgaatggaatcgaagagaatcatcgaatggacc

SEQ ID NO: 5306 - DNA, 110 bp, Homo Sapiens
gaaaggaatagaatggaatggatcgttatggaaagacatcgaatgggatggaattgactcgaatggattggactggaatggaacggactcgaatggaatggactggaatg

SEQ ID NO: 5307 - DNA, 94 bp, Homo Sapiens
taagcaatttcagcagtctcaggatacaaaatcaatgtgcaaaaatcacaagcattcttatacaccaacaacagacaaacagagagccaaatcg

SEQ ID NO: 5308 - DNA, 105 bp, Homo Sapiens
aacggaatcaaacggaattatcgaatggaatcgaagagaatcatcgaatggccacgaatggaatcatctaatggaatggaatggaataatccatggacccgaatg

SEQ ID NO: 5309 - DNA, 93 bp, Homo Sapiens
acatcaaacggaatcaaacggaattatcgaatggaatcgaaaagaatcatcgaacggactcgaatggaatcatctaatggaatggaatggaag

SEQ ID NO: 5310 - DNA, 74 bp, Homo Sapiens
atcgaatggaatcaacatcaaacggaaaaaaacggaattatcaaatggaatcgaagagaatcatcgaatggacc

SEQ ID NO: 5311 - DNA, 86 bp, Homo Sapiens
gaataatcattgaacggaatcgaatggaaacatcatcgaatggaaacgaatggaatcatcatcgaatggaaatgaaaggagtcatc

SEQ ID NO: 5312 - DNA, 110 bp, Homo Sapiens
catcaaacggaatcaaacggaattatcgaatggaatcgaaaagaatcatcgaacggactcgaatggaatcatctaatggaatggaatggaagaatccatggactcgaatg

SEQ ID NO: 5313 - DNA, 97 bp, Homo Sapiens
aaacggaatcaaacggaattatcgaatggaatcgaagagaatcatcgaatggactcgaatggaatcatctaatggaatggaatggaagaatccatgg

SEQ ID NO: 5314 - DNA, 87 bp, Homo Sapiens
atacacaaatcaataaatgtaatccagcatataaacagaaccaaagacaaaaaccatatgattatctcaatggatgcagaaaaggcc

SEQ ID NO: 5315 - DNA, 61 bp, Homo Sapiens
aatcgaatagaatcatcgaatggactcgaatggaatcatcgaatgtaatgatggaacagtc

SEQ ID NO: 5316 - DNA, 124 bp, Homo Sapiens
tggaatggaatcatcgcatagaatcgaatggaattaccatcgaatgggatcgaatggtatcaacatcaaacgcaaaaaaacggaattatcgaatggaatcgaagagaatcttcgaacggacccg

SEQ ID NO: 5317 - DNA, 63 bp, Homo Sapiens
atggaatggaatggaatggaattaaatggaatggaaaggaatggaatcgaatggaaaggaatc

SEQ ID NO: 5318 - DNA, 102 bp, Homo Sapiens
gtcgaaatgaatagaatgcaatcatcatcaaatggaatccaatggaatcatcatcaaatagaatcgaatggaatcatcaaatggaatcgaatggagtcattg

SEQ ID NO: 5319 - DNA, 77 bp, Homo Sapiens
tggaattatcgaaagcaaacgaatagaatcatcgaatggactcgaatggaatcatcgaatggaatggaatggaacag

SEQ ID NO: 5320 - DNA, 69 bp, Homo Sapiens
aaaggaatggaatgcaatggaatgcaatggaatgcacaggaatggaatggaatggaatggaaaggaatg

SEQ ID NO: 5321 - DNA, 75 bp, Homo Sapiens
aatctaatggaatcaacatcaaacggaaaaaaacggaattatcgaatggaatcgaagagaatcatcgaatggacc

SEQ ID NO: 5322 - DNA, 100 bp, Homo Sapiens
tacacaacaaaagaaatactcaacacagtaaacagacaaccttcagaacaggagaaaatatttgcaaatacatctaacaaagggctaatatccagaatct

SEQ ID NO: 5323 - DNA, 70 bp, Homo Sapiens
tgcaatcctagtctcagataaaacagacattaaaccaacaaagatcaaaagagacaaagaaggccattac

SEQ ID NO: 5324 - DNA, 76 bp, Homo Sapiens
gaatcgaatggaatcaacatcaaacggaaaaaaacggaattatcgaatggaatcgaaaagaatcatcgaatggacc

SEQ ID NO: 5325 - DNA, 85 bp, Homo Sapiens
aatggaatcgaatggaatgcaatccaatggaatggaatgcaatgcaatggaatggaatcgaacggaatgcagtggaagggaatgg

SEQ ID NO: 5326 - DNA, 102 bp, Homo Sapiens
gaacacagaaaaatttcaaaggaataatcaacagggattgataactaactggatttagagagccaaggcaaagagaatcaaagcacagggcctgagtcggag

SEQ ID NO: 5327 - DNA, 81 bp, Homo Sapiens
agttgaatagaaccaatccgaatgaaatggaatggaatggaacggaatggaattgaatggaatggaatggaatgcaatgga

SEQ ID NO: 5328 - DNA, 90 bp, Homo Sapiens
aactcgattgcaatggaatgtaatgtaatggaatggaatggaattaacgcgaatagaatggaatggaatgtaatggaacggaatggaatg

SEQ ID NO: 5329 - DNA, 82 bp, Homo Sapiens
aagcggaatagaattgaatcatcattgaatggaatcgagtagaatcattgaaatcgaatggaatcatagaatggaatccaat

SEQ ID NO: 5330 - DNA, 94 bp, Homo Sapiens
aatggaatcgaaaggaatagaatggaatggatcgttatggaaagatatcgaatggaatggaattgactcgaatggaatggactggaatggaacg

SEQ ID NO: 5331 - DNA, 91 bp, Homo Sapiens
taacggaataatcatcgaacagaatcaaatggaatcatcattgaatggaattgaatggaatcttcgaatagacatgaatggaccatcatcg

SEQ ID NO: 5332 - DNA, 87 bp, Homo Sapiens
aacggaatcaaacggaattatcgaatggaatcgaatagaatcatcgaacggactcgaatggaatcatctaatggaatggaatggaag

SEQ ID NO: 5333 - DNA, 84 bp, Homo Sapiens
attggaatggaacggaacagaacggaatggaatggaatagaatggaatggaatggaatggtatggaatggaatggaatggtacg

SEQ ID NO: 5334 - DNA, 87 bp, Homo Sapiens
aatccacaaagacaacagaagaaaagacaacagtagacaaggatgtcaaccacattttggaagagacaagtaatcaaacacatggca

SEQ ID NO: 5335 - DNA, 118 bp, Homo Sapiens
gaatcgaatggaatcaacatcaaacggaaaaaaacggaattatcgaatggaatcgaaaagaatcatcgaacggactcgaatggaatcatctaatggaatggaatggaagaatccatgg

SEQ ID NO: 5336 - DNA, 73 bp, Homo Sapiens
aatggaatcgaatggaatcatcatcaaatggaatctaatggaatcattgaacggaattggatggaatcgtcat

SEQ ID NO: 5337 - DNA, 62 bp, Homo Sapiens
caacatcaaacggaaaaaaacggaattatcgaatggaatcgaagagaatcatcgaatggacc

SEQ ID NO: 5338 - DNA, 82 bp, Homo Sapiens
cacaaccaaagcaatgaaagaaaagcacagacttattgaaatgaaagtacacaccacagaatgggagcaggctcaagcaagc

SEQ ID NO: 5339 - DNA, 103 bp, Homo Sapiens
atcaaagggaatcaagcggaattatcgaatggaatcgaagagaatcatcgaatggactcgaatggaatcatgtgatggaatggaatggaataatccacggact

SEQ ID NO: 5340 - DNA, 77 bp, Homo Sapiens
ggaatcgaatggaatcaatatcaaacggagaaaaacggaattatcgaatggaatcgaagagaatcatcgaatggacc

SEQ ID NO: 5341 - DNA, 73 bp, Homo Sapiens
aggaatggacacgaacggaatgcaatcgaatggaatggaatctaatagaaaggaattgaatgaaatggactgg

SEQ ID NO: 5342 - DNA, 82 bp, Homo Sapiens
ggaagggaatcaaatgcaacagaatgtaatggaatggaatgcaatggaatgcaatggaatggaatggaatgcaatggaatgg

SEQ ID NO: 5343 - DNA, 133 bp, Homo Sapiens
aaattggattgaatcgaatcgaatggaaaaaatgaaatcaaatgaaattgaatggaatcgaaatgaatgtaaacaatggaatccaatggaatccaatggaatcgaatcaaatggttttgagtggcgtaaaatg

SEQ ID NO: 5344 - DNA, 85 bp, Homo Sapiens
aatggaagggaatggaatggaatcgaatcgaatggaacagaattcaatggaatggaatggaatggaatggaatcgaatggaatgg

SEQ ID NO: 5345 - DNA, 86 bp, Homo Sapiens
gaaaaatcattgaacggaatcgaatggaatcatcatcggatggaaacgaatggaatcatcatcgaatggaaatgaaaggagtcatc

SEQ ID NO: 5346 - DNA, 77 bp, Homo Sapiens
ggaatcgaatggaatcaacatcaaacggagaaaaacggaattatcgaatggaatcgaagagaatcatcgaatggacc

SEQ ID NO: 5347 - DNA, 93 bp, Homo Sapiens
aaagaaatgtcactgcgtatacacacacacgcacatacacacaccatggaatactactcagctatacaaaggaatgaaataatccacagccac

SEQ ID NO: 5348 - DNA, 77 bp, Homo Sapiens
ggaatcgaatggaatcaatatcaaacggaaaaaaacggaattatcgaatggaatcgaagagaatcatcgaatggacc

SEQ ID NO: 5349 - DNA, 76 bp, Homo Sapiens
tgaacggaatcgaatggaatcatcatcggatggaaacgaatggaatcatcatcgaatggaaatgaaaggagtcatc

SEQ ID NO: 5350 - DNA, 60 bp, Homo Sapiens
gaatagaacgaaatggaatggaatggaatggaatggaaaggaatggaatggaatggaacg

SEQ ID NO: 5351 - DNA, 136 bp, Homo Sapiens
tggaattatcgtcgaatagaatcgaatggtatcaacatcaaacggaaaaaaacggaattatcgaatggaatcgaagagaatcatcgaacggactcgaatggaatcatctaatggaatggaatggaataatccatgg

SEQ ID NO: 5352 - DNA, 124 bp, Homo Sapiens
gacaaaaagaatcatcatcgaatagaatcaaatggaatctttgaatggactcaaaaggaatatcgtcaaatggaatcaaaagccatcatcgaatggactgaaatggaattatcaaatggactcg

SEQ ID NO: 5353 - DNA, 97 bp, Homo Sapiens
aaccaaaccaagcaaacaaacaaacagtaaaaactcaataacaaccaacaaacaggaaataccaggtaattcagattatctagttatgtgccatagt

SEQ ID NO: 5354 - DNA, 148 bp, Homo Sapiens
gaatgaattgaatgcaaacatcgaatggtctcgaatggaatcatcttcaaatggaatggaatggaatcatcgcatagaatcgaatggaattatcaacgaatggaatcgaatggaatcatcatcagatggaaatgaatggaatcgtcat

SEQ ID NO: 5355 - DNA, 97 bp, Homo Sapiens
tggaatggaatcaaatcgcatggaatcgaatggaatagaaaagaatcaaacagagtggaatggaatggaatggaatggaatcatgccgaatggaatg

SEQ ID NO: 5356 - DNA, 148 bp, Homo Sapiens
aaatggaataatgaaatggaatcgaacggaatcatcatcaaaaggaaccgaatgaagtcattgaatggaatcaaaggcaatcatggtcgaatggaatcaaatggaaacagcattgaatagaattgaatggagtcatcacatggaatcg

SEQ ID NO: 5357 - DNA, 80 bp, Homo Sapiens
gaattaacccgaatagaatggaatggaatggaatggaacagaacggaacggaatggaatggaatggaatggaatggaatg

SEQ ID NO: 5358 - DNA, 109 bp, Homo Sapiens
aagatatacaagcagccaacaaacatacgaaagaatgctcaacatcactaatcctcagagaaatttaaatcaaaaccacaatgagttacaatctcataccagtcagaat

SEQ ID NO: 5359 - DNA, 94 bp, Homo Sapiens
agataagtggatgaacagatggacagatggatggatggatggatggatggatggatgcctggaagaaagaagaatggatagtaagctgggtata

SEQ ID NO: 5360 - DNA, 106 bp, Homo Sapiens
agaattacaaaccactgctcaacaaaataaaagagtacacaaacaaatggaagaatattccatgcttatggataggaagaatcaatattgtgaaaatggccatact

SEQ ID NO: 5361 - DNA, 93 bp, Homo Sapiens
catcgaatggactcgaatggaataatcattgaacggaatcgaagggaatcatcatcggatggaaacgaatggaatcatcatcgaatggaaatg

SEQ ID NO: 5362 - DNA, 105 bp, Homo Sapiens
aaaggaatcaaacggaattatcgaatggaatcgaaaagaatcatcgaacggactcgaatggaatcatctaatggaatggaatggaagaatccatggactcgaatg

SEQ ID NO: 5363 - DNA, 92 bp, Homo Sapiens
ggatataaacaagaaaacaactaatcacaactcaatatcaaagtgcaatgatggtgcaaaatgcaagtatggtggggacagagaaaggatgc

SEQ ID NO: 5364 - DNA, 61 bp, Homo Sapiens
aacatcaaacggaaaaaaacggaaatatcgaatggaatcgaagagaatcatcgaatggacc

SEQ ID NO: 5365 - DNA, 76 bp, Homo Sapiens
taaaatggaatcgaatggaatcaacatcaaatggaatcaaatggaatcattgaacggaattgaatggaatcgtcat

SEQ ID NO: 5366 - DNA, 84 bp, Homo Sapiens
aatcatcatcgaatggaatcgaatggtatcattgaatggaatcgaatggaatcatcatcagatggaaatgaatggaatcgtcat

SEQ ID NO: 5367 - DNA, 64 bp, Homo Sapiens
caatgcgtcaagctcagacgtgcctcactacggcaatgcgtcaagctcaggcgtgcctcactat

SEQ ID NO: 5368 - DNA, 101 bp, Homo Sapiens
taagctgataagcaactttagcaaagtctcaggatacaaaatcaatgtacaaaaatcacaagcattcttatacaccaacaacagacagacggagagccaaa

SEQ ID NO: 5369 - DNA, 55 bp, Homo Sapiens
aatcaaagaattgaatcgaatggaatcatctaatgtactcgaatggaatcaccat

SEQ ID NO: 5370 - DNA, 114 bp, Homo Sapiens
atgaacacgaatgtaatgcaatccaatagaatggaatcgaatggcatggaatataaagaaatggaatcgaagagaatggaaacaaatggaatggaattgaatggaatggaattg

SEQ ID NO: 5371 - DNA, 88 bp, Homo Sapiens
atcaaacggaatcaaacggaattatcgaatggaatcgaagagaatcatcgaacggactcgaatggaatcatctaatggaatgggatgg

SEQ ID NO: 5372 - DNA, 94 bp, Homo Sapiens
aatggaaaggaatcaaatggaatataatggaatgcaatggactcgaatggaatggaatggaatggacccaaatggaatggaatggaatggaatg

SEQ ID NO: 5373 - DNA, 91 bp, Homo Sapiens
ggaatacaacggaatggaatcgaaaaaaatggaaaggaatgaaatgaatggaatggaatggaatggaatggatgggaatggaatggaatgg

SEQ ID NO: 5374 - DNA, 95 bp, Homo Sapiens
gaatcaagcggaattatcgaatggaatcgaagagaatcatcgaaaggactcgaatggaatcatctaatggaatggaatggaataatacacggacc

SEQ ID NO: 5375 - DNA, 98 bp, Homo Sapiens
aagataacctgtgcccaggagaaaaacaatcaatggcaacaaaagcagaaacaacacaaatgatacaattagcagacagaaacattgagattgctatt

SEQ ID NO: 5376 - DNA, 88 bp, Homo Sapiens
aatggactccaatggaataatcattgaacggaatctaatggaatcatcatcggatggaaatgagtggaatcatcatcgaatggaatcg

SEQ ID NO: 5377 - DNA, 79 bp, Homo Sapiens
aatctataaacgtaatccatcacataaacaggaccaaagagaaaaaccgcatgattatctcaagaatgcagaaaaggcc

SEQ ID NO: 5378 - DNA, 95 bp, Homo Sapiens
taattgattcgaaattaatggaattgaatggaatgcaatcaaatggaatggaatgtaatgcaatggaatgtaatagaatggaaagcaatggaatg

SEQ ID NO: 5379 - DNA, 78 bp, Homo Sapiens
aaaggaatggacttgaacaaaatgaaatcgaacgataggaatcgtacagaacggaaagaaatggaacggaatggaatg

SEQ ID NO: 5380 - DNA, 94 bp, Homo Sapiens
tgagcagggaacaatgcggataaatttcacaaatacaatgttgagcaaaagaaagacacaaaagaatacacacatacacaccatatgggctagg

SEQ ID NO: 5381 - DNA, 79 bp, Homo Sapiens
aatggaatcgaacggaatcatcatcaaacggaaccgaatggaatcattgaatggaatcaaaggcaatcatggtcgaatg

SEQ ID NO: 5382 - DNA, 85 bp, Homo Sapiens
aatggaatggaatgtacaagaaaggaatggaatgaaaccgaatggaatggaatggacgcaaaatgaatggaatggaagtcaatgg

SEQ ID NO: 5383 - DNA, 54 bp, Homo Sapiens
aacggaaaaaaacggaattatcgaatggaatcgaagagaatcatcgaatggacc

SEQ ID NO: 5384 - DNA, 87 bp, Homo Sapiens
ggaataatcattgaacggaatcgaatggaatcatcatcggatggaaacgaatggaatcatcatcgaatggaaatgaaaggagtcatc

SEQ ID NO: 5385 - DNA, 82 bp, Homo Sapiens
ggaacgaaatcgaatggaacggaatagaatagactcgaatgtaatggattgctatgtaattgattcgaatggaatggaatcg

SEQ ID NO: 5386 - DNA, 80 bp, Homo Sapiens
tgaaaggaatagactggaacaaaatgaaatcgaatggtaggaatcatacagaacagaaagaaatggaacggaatggaatg

SEQ ID NO: 5387 - DNA, 75 bp, Homo Sapiens
aacccgaatagaatggaatggaatggaatggaacggaacggaatggaatggaatggattggaatggaatggaatg

SEQ ID NO: 5388 - DNA, 90 bp, Homo Sapiens
aaagagaatcaaatggaattgaatcgaatggaatcgaatggattggaaaggaatagaatggaatggaatggaatggaatggaatggaatg

SEQ ID NO: 5389 - DNA, 70 bp, Homo Sapiens
aatggaatcatcagtaatggaatggaaaggaatggaaaggactggaatggaatggaatggaatggaatgg

SEQ ID NO: 5390 - DNA, 116 bp, Homo Sapiens
ggaacaaaatgaaatcgaacggtaggaatcgtacagaacggaaagaaatggaacggaatggaatgcactcaaatggaaaggagtccaatggaatcgaaaggaatagaatggaatgg

SEQ ID NO: 5391 - DNA, 132 bp, Homo Sapiens
agaatgagatcaagcagtataataaaggaagaagtagcaaaattacaacagagcagtgaaatggatatgctttctggcaataattgtgaaaggtctggtaatgagaaagtagcaacagctagtggctgccac

SEQ ID NO: 5392 - DNA, 98 bp, Homo Sapiens
aacaaatggaatcaacatcgaatggaatcgaatggaaacaccatcgaattgaaacgaatggaattatcatgaaattgaaatggatggactcatcatcg

SEQ ID NO: 5393 - DNA, 125 bp, Homo Sapiens
taacatgcagcatgcacacacgaatacacaacacacaaacatgtatgcacgcacacgtgaatacacaacacacacaaacatgcatgcatgcatacatgaatacacagcacacaaatatccagcat

SEQ ID NO: 5394 - DNA, 72 bp, Homo Sapiens
gaatggaatcaacatcaaacggaaaaaaaacggaattatcgaatggaatcgaatagaatcatcgaatggacc

SEQ ID NO: 5395 - DNA, 98 bp, Homo Sapiens
aatcgaatgaaatggagtcaaaaggaatggaatcgaatggcaagaaatcgaatgtaatggaatcgcaaggaattgatgtgaacggaacggaatggaat

SEQ ID NO: 5396 - DNA, 91 bp, Homo Sapiens
aatggaattgaacggaaacatcagcgaatggaatcgaaaggaatcatcatggaatagattcgaatggaatggaaaggaatggaatggaatg

SEQ ID NO: 5397 - DNA, 132 bp, Homo Sapiens
atggaatcaacatcaaacagaatcaaacggaattatcgaatggaatcgaagacaatcatcgaatggactcgaatggaatcatctaatggaatggaatggaagaatccatggtctcgaatgcaatcatcatcg

SEQ ID NO: 5398 - DNA, 86 bp, Homo Sapiens
gaataatcattgaacggaatcgaatggaatcatcttcggatggaaacgaatggaatcatcatcgaatggaaatgaaaggagtcatc

SEQ ID NO: 5399 - DNA, 88 bp, Homo Sapiens
aatggactcgaatggaataatcattgaacggaatcgaatggaatcatcatcggatggaaatgagtggaatcatcatcgaatggaatcg

SEQ ID NO: 5400 - DNA, 98 bp, Homo Sapiens
aaatgaaatcgaacggtaggaatcgtacagaacggaaagaaatggaacggaatggaatgcaatcgaatggaaaggagtccaatggaagggaatcgaat

SEQ ID NO: 5401 - DNA, 93 bp, Homo Sapiens
taccaaacatttaaagaacaaatatcaatcctacgcaaaccattctgaaacacagagatggaggatatacagcgaaactcattctacatggcc

SEQ ID NO: 5402 - DNA, 106 bp, Homo Sapiens
tattggaatggaatggaatggagtcgaatggaacggaatgcactcgaatggaaggcaatgcaatggaatgcactcaacaggaatagaatggaatggaatggaatgg

SEQ ID NO: 5403 - DNA, 64 bp, Homo Sapiens
ggaatttaatagaatgtacccgaatggaacggaatggaatggaattgtatggcatggaatggaa

SEQ ID NO: 5404 - DNA, 97 bp, Homo Sapiens
gcaatccaatagaatggaatcgaatggcatggaatataaagaaatggaatcgaagagaatggagacaaatggaatggaattgaatggaatggaattg

SEQ ID NO: 5405 - DNA, 118 bp, Homo Sapiens
aatggaatcgaatggaatcatcatcaaatggaatctaatggaatcattgaacggaattaaatggaatcgtcatcgaatgaattcaatgcaatcaacgaatggtctcgaatggaaccac

SEQ ID NO: 5406 - DNA, 106 bp, Homo Sapiens
aattgcaaaagaaacacacatatacacatataaaactcaagaaagacaaaactaacctatggtgatagaaatcagaaaagtacagtacattggttgtcttggtggg

SEQ ID NO: 5407 - DNA, 89 bp, Homo Sapiens
tgacatcattattatcaagaaacattcttaccactgttaccaacttcccaacacagactatggagagagagataagacagaatagcatt

SEQ ID NO: 5408 - DNA, 89 bp, Homo Sapiens
aaagaattgaattgaatagaatcaccaatgaattgaatcgaatggaatcgtcatcgaatggaatcgaagggaatcattggatgggctca

SEQ ID NO: 5409 - DNA, 87 bp, Homo Sapiens
atcatcgaatggaatcgaatggaatcaatatcaaacggaaaaaaacggaattatcgaatggaatcgaatagaatcatcgaatggacc

SEQ ID NO: 5410 - DNA, 83 bp, Homo Sapiens
gaatgaaatcgtatagaatcatcgaatgcaactgaatggaatcattaaatggacttgaaaggaattattatggaatggaattg

SEQ ID NO: 5411 - DNA, 90 bp, Homo Sapiens
taagcaacttcagcaaagtctcaggatacaaaatcaatgtgcaaaaatctcaagcattcttatacacgaacaacagacaaacagagagct

SEQ ID NO: 5412 - DNA, 79 bp, Homo Sapiens
actcaaaaggaattgattcgaatggaatagaatggcaaggaatagtattgaattgaatggaatggaatggacccaaatg

SEQ ID NO: 5413 - DNA, 95 bp, Homo Sapiens
gaatggaatttaaaggaatagaatggaaggaatcggatggaatggaatggaatagaatggagtcgaatggaatagaatcgaatggaatggcattg

SEQ ID NO: 5414 - DNA, 124 bp, Homo Sapiens
tgagaaaatgatggaaaagaggaataaaacgaaacaaaaccacaggaacacaggtgcatgtgaatgtgcacagacaaagatacagggcggactgggaaggaagtttctgcaccagaatttgggg

SEQ ID NO: 5415 - DNA, 86 bp, Homo Sapiens
aacaaaaaatgagtcaagccttaaataaaatcagagccaaaaaagaagacattacatctgataagacaaaaattcaaaggaccatc

SEQ ID NO: 5416 - DNA, 96 bp, Homo Sapiens
aacccagtggaattgaattgaatggaattgaatggaatggaaagaatcaatccgagtcgaatggaatggtatggaatggaatggcatggaatcaac

SEQ ID NO: 5417 - DNA, 65 bp, Homo Sapiens
atcaacatcaaacggaaaaaaaacggaattatcgaatggaatcgaagagaatcatcgaatggacc

SEQ ID NO: 5418 - DNA, 92 bp, Homo Sapiens
aaggaatggaatggtacggaatagaatggaatggaacgaattgtaatggaatggaatttaatggaacggaatggaatggaatggaatcaacg

SEQ ID NO: 5419 - DNA, 66 bp, Homo Sapiens
aacggaatggaaagcaatttaatcaaatgcaatacagtggaattgaagggaatggaatggaatggc

SEQ ID NO: 5420 - DNA, 150 bp, Homo Sapiens
aatcgaatggaacggaatagaatagactcgaatgtaatggattgctatgtaattgattcgaatggaatggaatcgaatggaatgcaatccaatggaatggaatgcaatgcaatggaatggaatcgaacggaatgcagtggaagggaatgg

SEQ ID NO: 5421 - DNA, 87 bp, Homo Sapiens
tagcaacattttagtaacatgatagaaacaaaacagcaacatagcaatgcaatagtaacacaacagcaacatcataacatggcagca

SEQ ID NO: 5422 - DNA, 79 bp, Homo Sapiens
aatggaatcgaagagaatggaaacaaatggaatggaattgaatggaatggaattgaatggaatgggaaggaatggagtg

SEQ ID NO: 5423 - DNA, 136 bp, Homo Sapiens
agcaaacaagtgaataaacaagcaaacaagtgaacaagcaaacaagtgaataaacaagcaaacaagtgaacaagcaaacaagtgaataaacaagcaaacaagtgaacaaggaaacaagtgaataaacaaaggctct

SEQ ID NO: 5424 - DNA, 94 bp, Homo Sapiens
aatggaatcaacacgagtgcaattgaatggaatcgaatggaatggaatggaatggaatgaattcaacccgaatggaatggaaaggaatggaatc

SEQ ID NO: 5425 - DNA, 76 bp, Homo Sapiens
gaatcgaatggaatcaacatcaaacggaaaaaaacggaattatcgaatggaatcgaagagaatcatcgaatggacc

SEQ ID NO: 5426 - DNA, 141 bp, Homo Sapiens
aacacgaatgtaatgcaatccaatagaatggaatcgaatggcatggaatataaagaaatggaatcgaagagaatggaaacaaacggaatggaattgaatggaatggaattgaatggaatgggaacgaatggagtgaaattg

SEQ ID NO: 5427 - DNA, 146 bp, Homo Sapiens
gaatggaacggaatagaacagactcgaatgtaatggattgctatgtaattgattcgaatggaatggaatcgaatggaatgcaatccaatggaatggaatgcaatgcaatggaatggaatcgaatggaatgcagtggaagggaatgg

SEQ ID NO: 5428 - DNA, 76 bp, Homo Sapiens
gaatcgaatggaatcaatatcaaacggaaaaaaacggaattatcgaatggaatcgaagagaatcatcgaatggacc

SEQ ID NO: 5429 - DNA, 136 bp, Homo Sapiens
ataaacatcaaacggaatcaaacggaattatcgaatggaatcgaagagaataatcgaatggactcaaatggagtcatctaatggaatggtatggaagaatccatggactccaacgcaatcatcagcgaatggaatc

SEQ ID NO: 5430 - DNA, 101 bp, Homo Sapiens
aaaagaaaagacaaaagacaccaattgccaatactgaaatgaaaaaacaggtaataactattgatcccatggacattaaaatgatgttgaaggaacaccac

SEQ ID NO: 5431 - DNA, 76 bp, Homo Sapiens
aatgtcaagtggaatcgagtggaatcatcgaaagaaatcgaatggaatcgaagggaatcattggatgggctcaaat

SEQ ID NO: 5432 - DNA, 87 bp, Homo Sapiens
atcatcgaatggaatagaatggtatcaacatcaaacggagaaaaacggaattatcgaatggaatcgaagagaatcttcgaacggacc

SEQ ID NO: 5433 - DNA, 122 bp, Homo Sapiens
gaatggaatcatcgcatagaatcggatggaattatcatcgaatggaatcgaatggtatcaacatcaaacggaaaaaaacggaattatcgaatggaatcgaattgaatcatcgaacggacccg

SEQ ID NO: 5434 - DNA, 133 bp, Homo Sapiens
aatggactcgaatggaataatcattgaacggaatcgaatggaatcatcatcggatggaaatgaatggaataatccatggactcgaatgcaatcatcatcgaatggaatcgaatggaatcatcgaatggactcg

SEQ ID NO: 5435 - DNA, 70 bp, Homo Sapiens
aatgcaatcatcaactggcttcgaatggaatcatcaagaatggaatcgaatggaatcatcgaatggactc

SEQ ID NO: 5436 - DNA, 68 bp, Homo Sapiens
aagagaccaataaggaataagtaagcaacaagaggaaggagaaaagggcaagagagatgaccagagtt

SEQ ID NO: 5437 - DNA, 87 bp, Homo Sapiens
tggaatcatcataaaatggaatcgaatggaatcaacatcaaatggaatcaaatggaatcattgaacggaattgaatggaatcgtcat

SEQ ID NO: 5438 - DNA, 117 bp, Homo Sapiens
ggaatcatcgcatagaatcgaatggaattatcatcgaatggaatcgaatggaatcaacatcaaacgaaaaaaaaccggaattatcgaatggaatcgaagagaatcatcgaacggacc

SEQ ID NO: 5439 - DNA, 85 bp, Homo Sapiens
aaatcatcatcgaatgggatcgaatggtatccttgaatggaatcgaatggaatcatcatcagatggaaatgaatggaatcgtcat

SEQ ID NO: 5440 - DNA, 104 bp, Homo Sapiens
ggaatgtaatagaacggaaagcaatggaatggaacgcactggattcgagtgcaatggaatctattggaatggaatcgaatggaatggtttggcatggaatggac

SEQ ID NO: 5441 - DNA, 84 bp, Homo Sapiens
aaacaatggaagataatggaaagatatcgaatggaatagaatggaatggaatggactcaaatggaatggactttaatggaatgg

SEQ ID NO: 5442 - DNA, 148 bp, Homo Sapiens
ggaacgaaatcgaatggaacggaatagaatagactcgaatgtaatggattgctatgtaattgattcgaatggaatggaatcgaatggaatgcaatccaatggaatggaatgcaatgcaatgaatggaatggaatggaatggaatggaa

SEQ ID NO: 5443 - DNA, 85 bp, Homo Sapiens
aaaccgaatggaatggaatggacgcaaaatgaatggaatggaagtcaatggactcgaaatgaatggaatggaatggaatggaatg

SEQ ID NO: 5444 - DNA, 77 bp, Homo Sapiens
ggaatcgaatggaatcaacatcaaacggaaaaaaacagaattatcgtatggaatcgaatagaatcatcgaatggacc

SEQ ID NO: 5445 - DNA, 96 bp, Homo Sapiens
caacccgagtggaataaaatggaatggaatggaatgaaatggaatggatcggaatggaatccaatggaatcaactggaatggaatggaatggaatg

SEQ ID NO: 5446 - DNA, 88 bp, Homo Sapiens
tatcatcgaatggaatcgaatggaatcaacatcaaacggaaaaaaacggaattatcgaatggaatcgaagagaatcatcgaatggacc

SEQ ID NO: 5447 - DNA, 88 bp, Homo Sapiens
cggaataatcattgaacggaatcgaatggaatcatcatcggatggaaacgaatggaatcatcatcgaatggaaatgaaaggagtcatc

SEQ ID NO: 5448 - DNA, 83 bp, Homo Sapiens
caacacacagagattaaaacaaacaaacaaacaatccagccctgacatttatgagtttacagactggtggagaggcagagaag

SEQ ID NO: 5449 - DNA, 71 bp, Homo Sapiens
cactacaaaccacgctcaaggcaataaaagaacacaaacaaatggaaaaacattccatgctcatggatggg

SEQ ID NO: 5450 - DNA, 75 bp, Homo Sapiens
aatcgaatggaattaacatcaaacggaaaaaaacggaattatcgaatggaatcgaagagaatcatcgaatggacc

SEQ ID NO: 5451 - DNA, 82 bp, Homo Sapiens
tggaaaagaatcaaattgaatggcatcgaacggaatgggatggaatggaatagacccagatgtaatggactcgaatggaatg

SEQ ID NO: 5452 - DNA, 95 bp, Homo Sapiens
gactaatattcagaatatacaaggaactcaaacaactcaacagtagaaaaaaaaacctgaatagacatttctcaaaagaagacatacaaatggcc

SEQ ID NO: 5453 - DNA, 67 bp, Homo Sapiens
ggtccattcgatgattctcttcgattccattcgataattccgttttttcccgtttgatgttgattcc

SEQ ID NO: 5454 - DNA, 147 bp, Homo Sapiens
ggaacgaaatcgaatggaacggaatagaatagactcgaatgtaatggattgctatgtaattgattcgaatggaatggaatcgaatggaatgcaatccaatggaatggaatgcaatgcaatgaatggaatggaatggaatggaatgga

SEQ ID NO: 5455 - DNA, 91 bp, Homo Sapiens
agcaacttcagtaaagtgtcaggatacaaaatcaatgtgcaaaaatcacaagcattcttatacatcaataacagacaaacagagagccaaa

SEQ ID NO: 5456 - DNA, 86 bp, Homo Sapiens
gaataatcattgaacggaatcgaatggaatcatcatcggatggaaacgaatggaatcatcatcgaatggaaatgaaaggagtcatc

SEQ ID NO: 5457 - DNA, 66 bp, Homo Sapiens
taatcatcttcgaattgaaaacaaagcaatcattaaatgtactctaacggaatcatcgaatggacc

SEQ ID NO: 5458 - DNA, 77 bp, Homo Sapiens
ggaatcgaatggaatcaacatcaaacggaaaaaaacggaattatcgaatggaatcgaagagaatcatcgaatggacc

SEQ ID NO: 5459 - DNA, 86 bp, Homo Sapiens
agagaaaagatgatcatgtaaccattgaaaagacaatgtacaaaactaatactaatcacacaggaccagaaagcaatttagaccat

SEQ ID NO: 5460 - DNA, 79 bp, Homo Sapiens
aatggaatcgaatggaatcaacatcaaacggaaaaaacggaattatcgaatggaatcaaagagaatcatcgaatggacc

SEQ ID NO: 5461 - DNA, 96 bp, Homo Sapiens
aatggaattatcatcgaatggaatcgaatggaatcaacatcaaacggaaaaaaacggaattatcgaatggaatcgaagagaatcatcgaatggacc

SEQ ID NO: 5462 - DNA, 149 bp, Homo Sapiens
gtcaacacaggaccaacataggaccaacacagggtcaacacaggaccaacataggaccaacacagggtcaacacaagaccaacatgggaccaacacagggtcaacataggaccaacatgggaccaacacagggtcaacacaggaccaac

SEQ ID NO: 5463 - DNA, 79 bp, Homo Sapiens
gaatcaactcgattgcaatcgaatggaatggaatggtattaacagaatagaatggaatggaatggaatggaacggaacg

SEQ ID NO: 5464 - DNA, 105 bp, Homo Sapiens
actcgaatgcaatcaacatcaaacggaatcaaacggaattatcgaatggaatcgaagagaatcatcgaacggactcgaatggaatcatctaatggaatggaatgg

SEQ ID NO: 5465 - DNA, 86 bp, Homo Sapiens
aatggaatggaataatcgacggacccgaatgcaatcatcatcgtacagaatcgaatggaatcatcgaatggactggaatggaatgg

SEQ ID NO: 5466 - DNA, 106 bp, Homo Sapiens
aatacaaaccactgctcaacgaaataaaagaggatacaaacaaatggaagaacattctatgctcatgggtaggatgaattcatatcgtgaaaatggccatactgcc

SEQ ID NO: 5467 - DNA, 142 bp, Homo Sapiens
aaacacgcaaacacacacacaagcacactaccacacaagcggacacacatgcaaacacgcgaacacacacacatatacacacaagcacattacaaaacacaagcaaacaccagcagacacacaaacacacaaacatacatgg

SEQ ID NO: 5468 - DNA, 76 bp, Homo Sapiens
aatcgaacggaatcaacatcaaacggaaaaaaaacggaattatcgaatggaatcgaagagaatcatcgaatggacc

SEQ ID NO: 5469 - DNA, 81 bp, Homo Sapiens
taattgattcgaatggaatggaatagaatggaattgaatggaatggaccataatggattggactttaatagaaagggcatg

SEQ ID NO: 5470 - DNA, 88 bp, Homo Sapiens
agcaacttcagcaaagtctcaggatacaaaatcaatgtacaaaagtcacaagcattcttatacaccaacaaaagacaaacagagagcc

SEQ ID NO: 5471 - DNA, 68 bp, Homo Sapiens
acatcaaacggaaaaaaaaaacaaaacggaattatcgaatggaatcgaagagaatcatcgaatggacc

SEQ ID NO: 5472 - DNA, 81 bp, Homo Sapiens
gaaattccaattaaaatgaaatcgacttatcttaacaaatatagcaatgctgacaacacttctccggatatgggtactgct

SEQ ID NO: 5473 - DNA, 92 bp, Homo Sapiens
acatctcacttttagtaatgaacagatcattcagacagaaaattagcaaagaaacatcagagttaaactacactctaaaccaaatggaccta

SEQ ID NO: 5474 - DNA, 88 bp, Homo Sapiens
gaagaaagcattcattcaagacatctaactcgttgatataatgcatacagttcaaaatgattacactatcattacatctagggctttc

SEQ ID NO: 5475 - DNA, 62 bp, Homo Sapiens
acacacacattcaaagcagcaatatttacaacagccaaaaggtggaaacaattgagcaattg

SEQ ID NO: 5476 - DNA, 87 bp, Homo Sapiens
atcatcgaatagaatcgaatggtatcaacaccaaacggaaaaaaacggaattatcgaatggaatcgaagagaatcttcgaacggacc

SEQ ID NO: 5477 - DNA, 63 bp, Homo Sapiens
atcaacatcaaacggaaaaaacggaattatcgaatggaatcgaagagaatcatcgaacggacc

SEQ ID NO: 5478 - DNA, 92 bp, Homo Sapiens
aatcgaaaggaatgtcatcgaatggaatggactcaaatggaatagaatcggatggaatggcatcgaatggaatggaatggaattggatggac

SEQ ID NO: 5479 - DNA, 138 bp, Homo Sapiens
aacatgaacagtggaacaatcagtgaaccaatacaagggttaaataagctagcaattaaaagctgtatcactggtctaaagatagaagatcaagtagaaaatcagcgcaagaggaaagatatacgaaaactaatggcc

SEQ ID NO: 5480 - DNA, 123 bp, Homo Sapiens
cgaatggaatcattatggaatggaatgaaatggaataatcaaatggaattgaatggaatcatcgaatggaatcgaacaaaatcctctttgaatggaataagatggaatcaccaaatggaattg

SEQ ID NO: 5481 - DNA, 79 bp, Homo Sapiens
aagggaattgaatagaatgaatccgaatggaatggaatggaatggaatggaatggaatggaatggaatggaatggaatg

SEQ ID NO: 5482 - DNA, 84 bp, Homo Sapiens
gaatggaatcgaatcaaattaaatcaaatggaatgcaatagaagggaatacaatggaatagaatggaatggaatggaatggact

SEQ ID NO: 5483 - DNA, 100 bp, Homo Sapiens
aaacggaatcaaacggaattatcgaatggaatcgaagagaatcatcgaacggactcgaatggaatcatctaatggaatggaatggaagaatccatggact

SEQ ID NO: 5484 - DNA, 101 bp, Homo Sapiens
atggaatcaacatcaaacggaaaaaaaaacggaattatcgaatggaatcgaagagaatcatcgaatggaccagaatggaatcatctaatggaatggaatgg

SEQ ID NO: 5485 - DNA, 88 bp, Homo Sapiens
aatggaatcatcatcgaatggaatcgaatggaatcatggaatggaatcaaatggaatcaaatggaatcgaatggaatggaatggaatg

SEQ ID NO: 5486 - DNA, 87 bp, Homo Sapiens
aacggaatcaaacggaattaccgaatggaatcgaatagaatcatcgaacggactcgaatggaatcatctaatggaatggaatggaag

SEQ ID NO: 5487 - DNA, 97 bp, Homo Sapiens
aaacggaatcaaacggaattatcgaatggaatcgaaaagaatcatcgaacggactcgaatggaatcatctaatggaatggaatggaagaatccatgg

SEQ ID NO: 5488 - DNA, 71 bp, Homo Sapiens
gaatgatacggaatacaatggaatggaacgaaatgaaatggaatggaatggaatggaatggaatggaatgg

SEQ ID NO: 5489 - DNA, 104 bp, Homo Sapiens
acagcaagagagaaataaaacgacaagaaaactacaaaatgcctatcaatagttactttaaatatcagtggaccaaatcagtgaaacaaaagacacagagtggc

SEQ ID NO: 5490 - DNA, 89 bp, Homo Sapiens
aatggactcgaatggattaatcattgaacggaatcgaatggaatcatcatcggatggtaatgaatggaatcatcatcgaatggaatcgg

SEQ ID NO: 5491 - DNA, 101 bp, Homo Sapiens
gaatggaatcgaaaggaatgtcatcgaatggaatggaatggaacggaatggaatcgaatggaatggactcgaatggaatagaatcgaatgcaatggcatcg

SEQ ID NO: 5492 - DNA, 74 bp, Homo Sapiens
atcgaatggaatcaacatcagacggaaaaaaacggaattatcaaatggaatcgaagagaatcatcgaatggacc

SEQ ID NO: 5493 - DNA, 88 bp, Homo Sapiens
agcaacttcagcaaagtctcaggatacaaaatcaatgtgcaaaaatcaaaagcattcttatgcaccaataacagacacagagccaaat

SEQ ID NO: 5494 - DNA, 79 bp, Homo Sapiens
aatggaatggaacgcaattgaatggaatggaatggaacggaatcaacctgagtcaaatggaatggaatggaatggaatg

SEQ ID NO: 5495 - DNA, 82 bp, Homo Sapiens
ggaacgaaatcgaatggaacggaatagaatagactcgaatgtcatggattgctatgtaattgattggaatggaatggaatcg

SEQ ID NO: 5496 - DNA, 80 bp, Homo Sapiens
tagcaggaaacagcaaactcaaattaagtaatttcaagagcgtatcatcaatgaactattttcaaagatgtgggcaagat

SEQ ID NO: 5497 - DNA, 96 bp, Homo Sapiens
gaattgaaaggaatgtattggaataaaatggaatcgaataggttgaaataccataggttcgaattgaatggaatgggagggacaccaatggaattg

SEQ ID NO: 5498 - DNA, 89 bp, Homo Sapiens
aagcaacttcagcaaagtctcgggatacaaaatcaatgtgcaaaaatcacaagcattcttatacaccactaacagacaaatggagagtc

SEQ ID NO: 5499 - DNA, 113 bp, Homo Sapiens
gaatggaatcaacatcaaacggaaaaaaacggaattatcgaatggaatcgaagagaatcatcgaatggaccagaatggaatcatctaatggaatggaatggaataatccatgg

SEQ ID NO: 5500 - DNA, 77 bp, Homo Sapiens
aaaagcaattggactgattttaaatatacgtggcaacaaggataaactgctaatgatgggtttgcaaatacagatcg

SEQ ID NO: 5501 - DNA, 70 bp, Homo Sapiens
aatggaatcaacatcgaacggaaaaaaacggaattatcgaatggaatcgaagagaatcatcgaatggacc

SEQ ID NO: 5502 - DNA, 78 bp, Homo Sapiens
aaacggaattatcaaatggaatcgaagagaatcatcgaacggactcgaatggaatcatctaatggaatggaatggaag

SEQ ID NO: 5503 - DNA, 108 bp, Homo Sapiens
tgcaagataacacattttagttgacaccattgaaaacagttttaaccaagaatattagaaccaatgaagcagagaaatcaaaagggtggatggaactgccaaaggatg

SEQ ID NO: 5504 - DNA, 97 bp, Homo Sapiens
tagaacagaattgaatggaatggcatcaaatggaatggaaacgaaaggaatggaattgaatggactcaaatgttatggaatcaaagggaatggactc

SEQ ID NO: 5505 - DNA, 93 bp, Homo Sapiens
aagagaatcatcgaatggaatcgaatggaatcaacatcaaacggaaaaaaacggaattatcgaatggaatcgaagagaatcatcgaatggacc

SEQ ID NO: 5506 - DNA, 64 bp, Homo Sapiens
atcaacatcaaacggaaaaaaacggaattatcgaatggaatcgaagagaatcatcgaatggacc

SEQ ID NO: 5507 - DNA, 66 bp, Homo Sapiens
gaatcaacatcaaacggaaaaaaaccgaattatcgaatggaatcgaagagaatcatcgaatggacc

SEQ ID NO: 5508 - DNA, 106 bp, Homo Sapiens
atcaacatcaaacggaatcaaacggaattatcgaatggaatcgaagagaatcatcaaatggactcgaatggaatcatctaatggaatggaatggaagaatccatgg

SEQ ID NO: 5509 - DNA, 89 bp, Homo Sapiens
atcgaatggaatcattgaatggaaaggaatggaatcatcatggaatggaaacgaatggaatcactgaatggactcgaatgggatcatca

SEQ ID NO: 5510 - DNA, 90 bp, Homo Sapiens
attcagcctttaaaaaaagaagacagtcctgtcatttgtgacaatatgaatgaaacagacatcacattaaatgaaatgagccaggcgcag

SEQ ID NO: 5511 - DNA, 136 bp, Homo Sapiens
gaatgaaatgaaatcaaatggaatgtacatgaatggaatagaaaagaatgcatctttctcgaacggaagtgcattgaatggaaaggaatctactggaatggattcgaatggaatggaatgggatggaatggtatgg

SEQ ID NO: 5512 - DNA, 157 bp, Homo Sapiens
aacatcaaacggaatcaaacggaattatcgaatggaatcgaagagaatcatcgaacggactcgaatggaatcatctaatggaatggaatggaagaatccatggactcgaatgcaatcatcatcgaatgaaatcgaatggaatcatcgaatggactcg

SEQ ID NO: 5513 - DNA, 72 bp, Homo Sapiens
atggaattcaatggaatggacatgaatggaatggacttcaatggaatggtatcaaatggaatggaattcagt

SEQ ID NO: 5514 - DNA, 85 bp, Homo Sapiens
aatggaaaggaatcgaatggaagggaatgaaattgaatcaacaggaatggaagggaatagaatagacggcaatggaatggactcg

SEQ ID NO: 5515 - DNA, 88 bp, Homo Sapiens
agcaacttcagcaaagtatcaggatacaaaatcaatgtacaaaaatcccaagcattcttatacaccaacaacagacaaacagagagcc

SEQ ID NO: 5516 - DNA, 88 bp, Homo Sapiens
agcaacttcagcaaagtctcaggatacaaaatcgatgtgcaaaaatcacaagcattcttatacaccaacaacagataaacagagagcc

SEQ ID NO: 5517 - DNA, 106 bp, Homo Sapiens
aacggaaaaaaaacggaattatcgaatggaatcgaagagaatcatcgaatggaccagaatggaatcatctaatggaatggaatggaataatccatggactcgaatg

SEQ ID NO: 5518 - DNA, 102 bp, Homo Sapiens
ggaatcaaacggaattatcgaatggaatcgaagagaatcatagaacggactcaaatggaatcatctaatggaatggaatgggagaatccatggactcgaatg

SEQ ID NO: 5519 - DNA, 70 bp, Homo Sapiens
aatggaatcaatatcaaacggaaaaaaacggaattatcgaatggaatcgaagagaatcatcgaatggacc

SEQ ID NO: 5520 - DNA, 96 bp, Homo Sapiens
aacggaatcaaacggaattatcgaatggaatcgaaaagaatcatcgaacggactcgaatggaatcatctaatggaatggaatggaagaatccatgg

SEQ ID NO: 5521 - DNA, 90 bp, Homo Sapiens
aaacggaattatcgaatggaatcaaagagaatcatcgaatggccacgaatggaatcatataatggaatggaatggaataatccatggacc

SEQ ID NO: 5522 - DNA, 85 bp, Homo Sapiens
aatggaatcgaatggattgatatcaaatggaatggaatggaagggaatggaatggaatggaattgaaccaaatgtaatggatttg

SEQ ID NO: 5523 - DNA, 89 bp, Homo Sapiens
taaaagacggaacagatagaaagcagaaaggaaaggtgaattgcattaccactattcatactgccacacacatgacattaggccaagtc

SEQ ID NO: 5524 - DNA, 79 bp, Homo Sapiens
aatggaatcgaatggaacaatcaaatggactccaatggagtcatctaatggaatcgagtggaatcatcgaatggactcg

SEQ ID NO: 5525 - DNA, 102 bp, Homo Sapiens
taacacataaacaaacacagagacaaaatctccgagatgttaatctgctccagcaatacagaacaatttctattaccaacagaatgcttaatttttctgcct

SEQ ID NO: 5526 - DNA, 77 bp, Homo Sapiens
ggaatcgaatggaatcaacatcaaacggaaaaaaacggaattatcgaatggaatcaaagagaatcatcgaatggacc

SEQ ID NO: 5527 - DNA, 51 bp, Homo Sapiens
agaatggaaaggaatcgaaacgaaaggaatggagacagatggaatggaatg

SEQ ID NO: 5528 - DNA, 89 bp, Homo Sapiens
gaatcatcataaaatggaatcgaatggaatcaacatcaaatggaatcaaatggtctcgaatggaatcatcttcaaatggaatggaatgg

SEQ ID NO: 5529 - DNA, 127 bp, Homo Sapiens
aacaacaatgacaaacaaacaacaacgacaaagacatttatttggttcacaaatctccagggtgtacaagaagcatggtgccagcatctgctcagcttctgatgagggctctgggaagcttttactc

SEQ ID NO: 5530 - DNA, 96 bp, Homo Sapiens
aacggactcgaacggaatataatggaatggaatggattcgaaaggaatggaatggaatggacaggaaaagaattgaatgggattggaatggaatcg

SEQ ID NO: 5531 - DNA, 112 bp, Homo Sapiens
aacatcaaacgaaatcaaacggaattatcaaattgaatcgaagagaatcatcgaattgccacgaatgcaatcatctaatggtatggaatggaataatccatggacccagatg

SEQ ID NO: 5532 - DNA, 94 bp, Homo Sapiens
agaaattaacagcaaaagaaggatgcagtgcaactcaggacaacacatacaattcaagcaacaaatgtatagtggctgggcaccaaggatacag

SEQ ID NO: 5533 - DNA, 82 bp, Homo Sapiens
gcaataaaatcgactcagatagagaagaatgcaatggaatggaatggaatggaatggaatgggatggaatggtatggaatgg

SEQ ID NO: 5534 - DNA, 97 bp, Homo Sapiens
aatggactcgaatgaaatcatcatcaaacggaatcgaatggaatcattgaatggaaaggatgggatcatcatggaatggaaacgaatggaatcactg

SEQ ID NO: 5535 - DNA, 82 bp, Homo Sapiens
ccacataaaacaaaactacaagacaatgataaagttcacaacattaacacaatcagtaatggaaaagcctagtcaatggcag

SEQ ID NO: 5536 - DNA, 157 bp, Homo Sapiens
tggaatggaatggaatggaatcaaatcgcatggtaatgaatcaaatggaatcaaatcgaatggaaataatggaatcgaagggaaacgaatggaatcgaattgcactgattctactgacttcgaggaaaatgaaatgaaatgcggtgaagtggaatgg

SEQ ID NO: 5537 - DNA, 71 bp, Homo Sapiens
gaatgttatgaaatcaactcgaacggaatgcaatagaatggaatggaatggaatggaatggaatggaatgg

SEQ ID NO: 5538 - DNA, 104 bp, Homo Sapiens
aatggaatcattgaatggaatggaatggaatcatcaaagaaaggaatcgaagggaatcatcgaatggaatcaaacggaatcatcgaatggaatggaatggaatg

SEQ ID NO: 5539 - DNA, 68 bp, Homo Sapiens
ggaatcaacatcaaacggaaaaaaaacggaattatcgaatggaatcgaagagaatcatcgaatggacc

SEQ ID NO: 5540 - DNA, 69 bp, Homo Sapiens
ggaataatcatcatcaaacagaaccaaatggaatcattgaatggaatcaaaggcaatcatggtcgaatg

SEQ ID NO: 5541 - DNA, 108 bp, Homo Sapiens
gcatagaatcgaatggaattatcattgaatggaatcgaatggaatcaacatcaaacggaaaaaaacggaattatcgaatggaatcgaagagaatcatcgaatggaccc

SEQ ID NO: 5542 - DNA, 82 bp, Homo Sapiens
aatggaatcgaagagaatcatcgaacggactcgaatggaatcatctaatggaatggaatggaataatccatggacccgaatg

SEQ ID NO: 5543 - DNA, 99 bp, Homo Sapiens
aaatgaatcgaatggaattgaatggaatcaaatagaacaaatggaatcgaaatgaatcaaatggaatcgaatcgaatggaattgaatggcatggaattg

SEQ ID NO: 5544 - DNA, 79 bp, Homo Sapiens
agttaatccgaatagaatggaatggaatgcaatggaacggaatggaacggaatggaatggaatggaatggaatggaatg

SEQ ID NO: 5545 - DNA, 131 bp, Homo Sapiens
atcacaatcacacaacacattgcacatgcataacatgcactcacaatacacacacaacacatacacaacacacatgcaatacaacacaaaacgcaacacaacatatacacaacacacagcacacacatgcc

SEQ ID NO: 5546 - DNA, 87 bp, Homo Sapiens
aaagacttaaacgttagacctaaaaccataaaaaccctagaggaaaacctaggcattaccattcaggacttaggcatgggcaaggac

SEQ ID NO: 5547 - DNA, 108 bp, Homo Sapiens
aaagtccaaagatgaacaaaatatccagaaggaaaacaaatgcacttggggagtgggaaagaaaaccaagactgagcaatgcgtcaagctcagacgtgcctcactacg

SEQ ID NO: 5548 - DNA, 97 bp, Homo Sapiens
aaacggaatcaaacggaattatcgaatggagtcgaaaagaatcatcgaacggactcgaatggaatcatctaatggaatggaatggaagaatccatgg

SEQ ID NO: 5549 - DNA, 94 bp, Homo Sapiens
aattgattcgaaattaatggaattgaatggaatgcaatcaaatggaatggaatgtaatgcaatggaatgtaatagaatggaaagcaatggaatg

SEQ ID NO: 5550 - DNA, 79 bp, Homo Sapiens
tacagaacacatgactcaacaacagcagaaagcatattcttttcaaatgcacatgaaacattatcatgatggaccaaat

SEQ ID NO: 5551 - DNA, 65 bp, Homo Sapiens
ggaacaaaatgaaatcgaacggtaggaatcatacagaacagaaagaaatggaacggaatggaatg

SEQ ID NO: 5552 - DNA, 68 bp, Homo Sapiens
aacggaaaaaacggaattatcgaatggaatcgaagagaatcatcgaatggaatcgaatggagtcatcg

SEQ ID NO: 5553 - DNA, 75 bp, Homo Sapiens
aatcgaacggaatcaacatcaaacggaaaaaaacggaattatcgaatggaatcgaagagaatcatcgaatggacc

SEQ ID NO: 5554 - DNA, 87 bp, Homo Sapiens
agaatggaatgcaatagaatggaatgcaatggaatggagtcatccgtaatggaatggaaaggaatgcaatggaatggaatggaatgg

SEQ ID NO: 5555 - DNA, 165 bp, Homo Sapiens
atggaatcaacatcaaacggaatcaaacggaattatcgaatggaatcgaagagaatcatcgaacggattcgaatggaatcatctaatggaatggaatggaagaatccatggactcgaatgcaatcatcagcgaatggaatcgaatggaatcatcgaatggactcg

SEQ ID NO: 5556 - DNA, 98 bp, Homo Sapiens
ggaataaaacggactcaatagtaatggattgcaatgtaattgattcgatttcgaatggaatcgcatggaatgtaatggaatggaatggaatggaaggc

SEQ ID NO: 5557 - DNA, 70 bp, Homo Sapiens
aatggaatcaacatcaaacggaaaaaaacggaattatcgtatggaatcgaaaagaattatcgaatggacc

SEQ ID NO: 5558 - DNA, 57 bp, Homo Sapiens
tcaaacggaaaaaaacggaattatcgaatggaatcgaagagaatcatcgaatggacc

SEQ ID NO: 5559 - DNA, 111 bp, Homo Sapiens
acatcaaacggaatcaaacggaattatcgaatggaatcgaaaagaatcatcgaacggactcgaatggaatcatctaatggaatggaatggaagaatccatggactcgaatg

SEQ ID NO: 5560 - DNA, 78 bp, Homo Sapiens
tggaatcgaatggaatcaacatcaaacggaaaaaaacggaattatcgaatggaatcgaagagaatcatcgaatggacc

SEQ ID NO: 5561 - DNA, 76 bp, Homo Sapiens
aatggaatcgaatgcaatcatcgaacggaatcgaatggcatcaccgaatggaatggaatggaatggaatggaatgg

SEQ ID NO: 5562 - DNA, 87 bp, Homo Sapiens
agaattgattgaatccaagtggaattgaatggaatggaatggattagaaaggaatggaatggattggaatggattggaatggaaagg

SEQ ID NO: 5563 - DNA, 96 bp, Homo Sapiens
aactgcatcaactaacaggcaaaataaccagctaatatcataatgacaggattaaattcacaaatgacaatattaaccgtaaatgtaaatgggcta

SEQ ID NO: 5564 - DNA, 108 bp, Homo Sapiens
gtaaacaaacaatcaagcaagtaagaacagaaataacagcatttggcttttgagttaatgacaagaacactcggcatgggagcctgggtgagcaaatcacagatcttc

SEQ ID NO: 5565 - DNA, 84 bp, Homo Sapiens
aaaggaatggactggaacaaaatgaaatcgaacggtaggaatcgtacagaacggacagaaatggaacggcatggaatgcactcg

SEQ ID NO: 5566 - DNA, 91 bp, Homo Sapiens
gaatcaacccgagcggaaaggaatggaatggaatggaatcaacacgaatggaatggaacggaatggaatgggatgggatgaaatggaatgg

SEQ ID NO: 5567 - DNA, 71 bp, Homo Sapiens
aagaaatggaatcgaagagaatggaaacaaacggaatggaattgaatggaatggaattgaatggaatggga

SEQ ID NO: 5568 - DNA, 101 bp, Homo Sapiens
gacatgcaaacacaacacacagcacacatggaacatgcatcagacatgcaaacacaacacacataccacacatggcatatgcatcagacgtgcctcactac

SEQ ID NO: 5569 - DNA, 135 bp, Homo Sapiens
aaaggaatgcactcgaatggaatggacttgaatggaatgtctccgaatggaacagactcgtatgaaatggaatcgaatggaatggaatcaaatggaattgatttgagtgaaatggaatcaaatggaatggcaacg

SEQ ID NO: 5570 - DNA, 89 bp, Homo Sapiens
ggaacaaaatgaaatcgaacggtaggaatcgtacagaacggaaagaaatggaacggaatggaatgcactcgaatggaaaggagtccaat

SEQ ID NO: 5571 - DNA, 95 bp, Homo Sapiens
aaattgattgaaatcatcataaaatggaatcgaagggaatcaacatcaaatggaatcaaatggaatcattgaacggaattgaatggaatcgtcat

SEQ ID NO: 5572 - DNA, 84 bp, Homo Sapiens
agaatggaaagcaatagaatggaacgcactggattcgagtgcaatggaatcaattggaatggaatcgaatggaatggattggca

SEQ ID NO: 5573 - DNA, 103 bp, Homo Sapiens
aacaccaaacggaaaaaaacggaattatcgaatggaatcgaagagaatcttcgaacggacccgaatgggatcatctaatggaatggaatggaataatccatgg

SEQ ID NO: 5574 - DNA, 94 bp, Homo Sapiens
aatggagactaatgtaatagaatcaaatggaatggcatcgaatggaatggactggaatggaatgtgcatgaatggaatggaatcgaatggattg

SEQ ID NO: 5575 - DNA, 151 bp, Homo Sapiens
aaatcgaatggaacgcaatagaatagactcgaatgtaatggattgctatgtaattgattcgaatggaatggaatcgactggaatgcaatccaatggaatggaatgcaatgcaatggaatggaatcgaacggaatgcagtggaagggaatgg

SEQ ID NO: 5576 - DNA, 107 bp, Homo Sapiens
aatcaacaaggaactgaaacaagtaaacaagaaaacaaataacaccataaaacatgggcaaaggacataaacagacatttttcaaaaaagacatacaaatggccgag

SEQ ID NO: 5577 - DNA, 89 bp, Homo Sapiens
aatggaatcaacatcaaacggaaaaaaacggaattatcgaatggaatcgaagagaatcatcgaatggacccaggctggtcttgaactcc

SEQ ID NO: 5578 - DNA, 82 bp, Homo Sapiens
attgaatgggctagaatggaatcatctttgaacggaatcaaagggaatcatcatcgaatggaatcgaatggaaatgtcaacg

SEQ ID NO: 5579 - DNA, 143 bp, Homo Sapiens
aatggactcgaatggaatcaacatcaaatggaatcaagcggaattatcgaatgaaatcgaagagaatcatcgaatggactcgaaaggaatcatctaatggaatggaatggaataatccatggactcgaatgcaatcatcatcg

SEQ ID NO: 5580 - DNA, 97 bp, Homo Sapiens
aaacggaaaaaaacggaattattgaatggaatcgaagagaatcttcgaacggacccgaatggaatcatctaatggaatggaatggaataatccatgg

SEQ ID NO: 5581 - DNA, 79 bp, Homo Sapiens
actcgagtggaattgactgtaacaaaatggaaagtaacggattggaatcgaatggaacggaatggaatggaatggacat

SEQ ID NO: 5582 - DNA, 120 bp, Homo Sapiens
tacaaactttaaaaaatgatcaacagatacacagttagcaagaaagaattgagggcaaagaatatgccagacaaactcaagaggaagatgatggtagagataggtcacattggagtgtca

SEQ ID NO: 5583 - DNA, 66 bp, Homo Sapiens
aaatcaacaacaaacggaaaaaaaaggaattatcgaatggaatcaaagagaatcatcgaatggacc

SEQ ID NO: 5584 - DNA, 105 bp, Homo Sapiens
aacggaatcaaacggaattatcgaatggaatcgaaaagaatcatcgaacggactcgaatggaatcatctaatgtaatggaatggaagaatccatggactcgaatg

SEQ ID NO: 5585 - DNA, 105 bp, Homo Sapiens
aacggaaaaaaacggaattatcgaatggaatcgaagagaatcatcgaatggaccagaatggaatcatctaatggaatggaatggaataatccatggactcgaatg

SEQ ID NO: 5586 - DNA, 103 bp, Homo Sapiens
caacatcaaacggaaaaaaacggaattatggaatggaatcgaagagaatcatcgaatggacccgaatggaatcatctgaaatataatagactcgaaaggaatg

SEQ ID NO: 5587 - DNA, 78 bp, Homo Sapiens
atggaatcgaatggaatggactggaatggaatggattcgaatggaatcgaatggaacaatatggaatggtaccaaatg

SEQ ID NO: 5588 - DNA, 71 bp, Homo Sapiens
gaatggaatcaacatcaaacggaaaaaaacggaattatcgaatggaatcgaagagaatcatcgaatggacc

SEQ ID NO: 5589 - DNA, 89 bp, Homo Sapiens
aaatggactcgaatggaatcatcatagaatggaatcgaatgcaatggaatggaatcttccggaatggaatggaatggaatggaatggag

SEQ ID NO: 5590 - DNA, 85 bp, Homo Sapiens
gaatcatcataaaatggaatcgaatggaatcaacatcaaatggaatcaaatggaatcattgaacggaattgaatggaatcgtcat

SEQ ID NO: 5591 - DNA, 74 bp, Homo Sapiens
atcgaatggaatcaacatcaaacggaaaaaaacggaattatcgaatggaatcgaagagaatcatcgaatggacc

SEQ ID NO: 5592 - DNA, 92 bp, Homo Sapiens
agcaacttcagcaaagtctcaggatacaaaatcaatgtacaaaaatcacaagcattcttatacaccaataacagacaaacagagagccaaaa

SEQ ID NO: 5593 - DNA, 89 bp, Homo Sapiens
agaaacagaaaacagtcaaaccaatgggcaatccatatcagatgcagtattatgaacagaagtgtaaagaatgcaccaggcacaatggc

SEQ ID NO: 5594 - DNA, 131 bp, Homo Sapiens
gattggaacgaaatcgaatggaacggaatagaatagactcgaatgtaatggattgctatgtaattgattcgaatggaatggaatcgaatggaatgcaatccaatggaatggaatgcaatgcaatggaatgg

SEQ ID NO: 5595 - DNA, 126 bp, Homo Sapiens
atggaatggaataatcaacgtactcgaatgcaatcatcatcgtatagaatcgaatggaatcatcgaatggactcgaatggaataatcattgaacggagtcgaatggaatcatcatcggatggaaac

SEQ ID NO: 5596 - DNA, 95 bp, Homo Sapiens
aaagaaatcgaatggaatcagtgtcgaatggaatggaatggaatcgaagaattgaattgagtagaatcgaagggaatcattggatgggctcaaat

SEQ ID NO: 5597 - DNA, 77 bp, Homo Sapiens
agaaaagataactcgattaacaaatgaacaaacacctgaatacacaagtctcaaaagaagacataaaaatggccaac

SEQ ID NO: 5598 - DNA, 102 bp, Homo Sapiens
atggaatcaacatcaaacggaatcacacggaattatcgaatggaatcgaaaagaatcatcgaacggactcgaatggaatcatctaatggaatggaatggaag

SEQ ID NO: 5599 - DNA, 103 bp, Homo Sapiens
aatggaatcaacatcaaacggaatcaagcgaaattatcgaatggaatcgaagagaatcatcgaatggactcgaatggaatcatctaatggaatggaatgggat

SEQ ID NO: 5600 - DNA, 82 bp, Homo Sapiens
aaacacagtacaaatactaattcaaatcaaacttactcaaagtcataatcaaacatgccagacgggctgaggggcagcatta

SEQ ID NO: 5601 - DNA, 100 bp, Homo Sapiens
ggaatcgagtggaatcatcgaaagaaatcgaatggaatcattgtcgaatggaatggaatggaatcaaagaatggaatcgaagggaatcattggatgggct

SEQ ID NO: 5602 - DNA, 139 bp, Homo Sapiens
aaagaaagacagagaacaaacgtaattcaagatgactgtttacatatccaagaacattagatggtcaaagactttaagaaggaatacattcaaaggcaaaaagtcacttactgattttggtggagtttgccacatggac

SEQ ID NO: 5603 - DNA, 148 bp, Homo Sapiens
gaaaggaatcatcattgaatgcaatcacatggaatcatcacagaatggaatcgtacggaatcatcatcgaatggaattgaatggaatcatcaattggactcgaatggaatcatcaaatggaatcgattggaagtgtcaaatggactcg

SEQ ID NO: 5604 - DNA, 57 bp, Homo Sapiens
caatcagagcggacacaaacaaattgcatgggaagaatcaatatcgtgaaaatggcc

SEQ ID NO: 5605 - DNA, 72 bp, Homo Sapiens
cagcgcaccacagcacacacagtatacacatgacccacaatacacacaacacacaacacattcacacaccac

SEQ ID NO: 5606 - DNA, 87 bp, Homo Sapiens
gcaaacagaattcaacactacattagaacgatcattcatcacgacctagtaggatgtttttcctgggatgcaaggatggttcaacat

SEQ ID NO: 5607 - DNA, 71 bp, Homo Sapiens
caatcaaaacagcaatgagataccattttacaccaatcaaaatggctactaaaaagtcaaaagcaaatgcc

SEQ ID NO: 5608 - DNA, 93 bp, Homo Sapiens
tggaatagaatggaatcaatgttaagtggaatcgagtggaatcatcgaaagaaatcgaatggaatcattgtcgaatggtatggaatggaatca

SEQ ID NO: 5609 - DNA, 124 bp, Homo Sapiens
aatggaatggaatcatcgcatagaatggaatggaattatcatcgaattgaatcgaatggtatcaacatcaaacggaaaaaaacggaaatatcgaatggaatcgaagagaatcatcgaacggacc

SEQ ID NO: 5610 - DNA, 90 bp, Homo Sapiens
gaaaaacaaaacaaaacaaacaaacaaacaatcaaaaaagtggtagcagaaaccagaaagtccatgtatatagctaattggcctggttgt

SEQ ID NO: 5611 - DNA, 80 bp, Homo Sapiens
agacctttctcagaagacacacaaattgccaacaggtatatgaaaaaatgttcaatatcactaatcatcagggcgatgcc

SEQ ID NO: 5612 - DNA, 106 bp, Homo Sapiens
catggaatcgaatggaattatcatcgaatggaatcgaatggtaccaacaccaaacggaaaaaaacggaattatcgaatggaatcgaagagaatcttcgaacggacc

SEQ ID NO: 5613 - DNA, 87 bp, Homo Sapiens
agagcagaaacaaatggaattgaaatgaagacaacaatcaaaagcatcaatgaaatgaaaagttgggttttggaagagagaaacaat

SEQ ID NO: 5614 - DNA, 70 bp, Homo Sapiens
acacaaacacacacacacacacacacacacacacacacacacacacacacacacacacacacacacatac

SEQ ID NO: 5615 - DNA, 107 bp, Homo Sapiens
aacaaacaaatgagatgatttcagatagtgataaacactataacataattaattcgtgccaatcagagcataacagtggtgtggtggctgtggaacagatagcagac

SEQ ID NO: 5616 - DNA, 79 bp, Homo Sapiens
aatggaatcgagtggaatggaaggcaatggaatagaatggaatggaatcgaaaggaacggaatggaatggaatggaatg

SEQ ID NO: 5617 - DNA, 73 bp, Homo Sapiens
agaaatggaatcggagagaatggaaacaaatggaatggaattgaatggaatggaattgaatggaatgggaacg

SEQ ID NO: 5618 - DNA, 87 bp, Homo Sapiens
aagagaactgcaaaacactgctcaaagaaatcagagatgacaaaaacacatggaaaaacgtttcatgctcatggattggaagactta

SEQ ID NO: 5619 - DNA, 83 bp, Homo Sapiens
aatcaacacgaatagaatggaacggaatggaatggaatggaatggaatggaatggagtggaatggaacagaatggagtggaat

SEQ ID NO: 5620 - DNA, 112 bp, Homo Sapiens
aacatcaaacgaaatcaaacggaattatcaaattgaatcgaagagaatcatcgaattgccacgaatgcaaccatctaatggtatggaatggaataatccatggacccagatg

SEQ ID NO: 5621 - DNA, 94 bp, Homo Sapiens
cggaattatcatcgaatgtaatcgaatggaatcaacatcaaacggaaaaaaacggaattatcgaatggaatcgaagagaatcatcgaatggacc

SEQ ID NO: 5622 - DNA, 125 bp, Homo Sapiens
tggacacacacgaacacacacctacacacacgtggacacacacggacacatggacacacacgaacacatggacacacacacggggacacacacagacacacacagagacacacacggacacatgg

SEQ ID NO: 5623 - DNA, 100 bp, Homo Sapiens
atcaaacggaatcaaacggaattatcgaatggaatcgaagagaatcatcgaatggactcgaatggaatcatctaatggaatggaatggaagaatccatgg

SEQ ID NO: 5624 - DNA, 99 bp, Homo Sapiens
aaatggaatggaatgcacttgaaaggaatagactggaacaaaatgaaatcgaacggtaggaatcatacagaacagaaagaaatggaacggaatggaatg

SEQ ID NO: 5625 - DNA, 68 bp, Homo Sapiens
accacacacaaaatacaccacacaccacacacacaccacacactatacacacaccacacaccacacac

SEQ ID NO: 5626 - DNA, 100 bp, Homo Sapiens
aaagaaatagaagggagttgaacagaatcgaatggaatcgaatcaaatggaatcgaatggcatcaaatggaatcgaatggaatgtggtgaagtggattgg

SEQ ID NO: 5627 - DNA, 86 bp, Homo Sapiens
ggaatcatcataaaatggaatcgaatggaatcatcatcaaatggaatcaaatggaatcattgaacggaattgaatggaatcgtcat

SEQ ID NO: 5628 - DNA, 80 bp, Homo Sapiens
aaagatcaatgtacaaaaatcagcagcatttctataaaccaacaatgtccaggctgagagagaaatcaagaaaacaattc

SEQ ID NO: 5629 - DNA, 77 bp, Homo Sapiens
tggaatggaatggaatgaaataaacacgaatagaatggaacggaatggaacggaatggaatggaatggaatggaaag

SEQ ID NO: 5630 - DNA, 92 bp, Homo Sapiens
taatcagcacaatcaactgtagtcacaaaacaaatagtaacgcaatgataaagaaacagagaactagttcaaataaacatgataagatgggg

SEQ ID NO: 5631 - DNA, 78 bp, Homo Sapiens
aagcggaattatcaaatggaatcgaagagaatggaaacaaatggaatggaattgaatggaatggaattgaatggaatg

SEQ ID NO: 5632 - DNA, 70 bp, Homo Sapiens
aatggaatcaacatcaaacggaaaaaaacggaattatcgaatggaatcgaagagaatcatcgaatggacc

SEQ ID NO: 5633 - DNA, 92 bp, Homo Sapiens
acttgaatcgaatggaaaggaatttaatgaacttaaatcgaatggaatataatggtatggaatggactcatggaatggaatggaaaggaatc

SEQ ID NO: 5634 - DNA, 91 bp, Homo Sapiens
tggaatcatcatcgaaagcaagcgaatggaatcatcaaatggaaacgaatggaatcatcgaatggactcggatggaattgttgaatggact

SEQ ID NO: 5635 - DNA, 68 bp, Homo Sapiens
tggaatcaacatcaaacggaaaaaaacggaattatcgaatggaatcgaagagaatcatcgaatggacc

SEQ ID NO: 5636 - DNA, 86 bp, Homo Sapiens
taagtgaattgaatagaatcaatctgaatgtaatgaaatggaatggaacggaatggaatggaatggaatggaatggaatggaatgg

SEQ ID NO: 5637 - DNA, 98 bp, Homo Sapiens
aggaaaatttaatcagcaggaatagaaacacacttgagaaatccatgtggaatgaaaagagaatggctgagcagcaacagattgtcaaaaaggaaatc

SEQ ID NO: 5638 - DNA, 62 bp, Homo Sapiens
aacatcaaacggaaaaaaaacggaattatcgaatggaatcgaagagaatcatcgaatggacc

SEQ ID NO: 5639 - DNA, 132 bp, Homo Sapiens
taattgagaataagcattccagtggaaaaaaaactaaacaatttgttgtaaaacatccttaaaagcatcagaaagttaatacagcaatgaagaattacaggaccaaattaagaatggtatggaagcctgtta

SEQ ID NO: 5640 - DNA, 88 bp, Homo Sapiens
tatcatcgaatggaatcgaatggaatcaacatcaaacggaaaaaaacggaattatcgaattgaatcgaagagaatcatcgaatggacc

SEQ ID NO: 5641 - DNA, 80 bp, Homo Sapiens
agcaaaacaaacacaatctgtcgttcatggtactacgacatactgggagagatattcaaatgatcacacaaaacaacatg

SEQ ID NO: 5642 - DNA, 93 bp, Homo Sapiens
aaggattcgaatggaatgaaaaagaattgaatggaatagaacagaatggaatcaaatcgaatgaaatggagtggaatagaaaggaatggaatg

SEQ ID NO: 5643 - DNA, 147 bp, Homo Sapiens
aacggaatcaaacggaattatcgaatggaatcgaagagaatcatcgaacggactcgaatggaatcatctaatggaatggaatggaagaatccatggactcgaatgcaatcatcatcgaatggaatcgaacggaatcatcgaatggcc

SEQ ID NO: 5644 - DNA, 85 bp, Homo Sapiens
aatcaactagatgtcaatggaatgcaatggaatagaatggaatggaattaacacgaatagaatggaatggaatggaatggaatgg

SEQ ID NO: 5645 - DNA, 88 bp, Homo Sapiens
aatggactcgaatggaataatcattgaacggaatcgaatggaatcatcatcggatggaaatgaatggaatcatcatcgcatggaatcg

SEQ ID NO: 5646 - DNA, 76 bp, Homo Sapiens
gaatggaatgatacggaatagaatggaatggaacgaaatggaattgaaaggaaaggaatggaatggaatggaatgg

SEQ ID NO: 5647 - DNA, 84 bp, Homo Sapiens
aatcatcatcgaatggaatcgaatggtatcattgagtggaatcgaatggaatcatcatcagatggaaatgaatggaatcgtcat

SEQ ID NO: 5648 - DNA, 65 bp, Homo Sapiens
gaatcaaatcaatggaatcaaatcaaatggaatggaatggaattgtatggaatggaatggcatgg

SEQ ID NO: 5649 - DNA, 125 bp, Homo Sapiens
taatgcagtccaatagaatggaatcgaatggcatggaatataaagaaatggaatcgaagagaatgggaacaaatggaatggaattgagtggaatggaattgaatggaatgggaacgaatggagtg

SEQ ID NO: 5650 - DNA, 61 bp, Homo Sapiens
aacatcaaacggaaaaaaacggaattatcgaatggaatcgaagagaatcatcgaatggacc

SEQ ID NO: 5651 - DNA, 99 bp, Homo Sapiens
atcaaaaggaacggaatggaatggaatggaatggaatggaatggaatggaatggaatgaaatcaacccgaatggaatggattggcatagagtggaatgg

SEQ ID NO: 5652 - DNA, 80 bp, Homo Sapiens
gccaacaatcatatgagaaaaagctcaacatcactgatcatttcaggaatgcaaatcaaaaccacaatgagatactatca

SEQ ID NO: 5653 - DNA, 99 bp, Homo Sapiens
aatcaaatggaatgaaatcgaatggaattgaatcgaatggaatgcaatagaatgtcttcaaatggaatcgaatggaaattggtgaagtggacgggagtg

SEQ ID NO: 5654 - DNA, 71 bp, Homo Sapiens
taatggaatcaacatcaaacggaaaaaaacggaattatcgaatgcaatcgaagagaatcatcgaatggacc

SEQ ID NO: 5655 - DNA, 88 bp, Homo Sapiens
agcaacttcagcaaagtctcagcatacaaaatcaatgtgcaaaaatcacacgcattcctatacaccaataacagacaaacagagagcc

SEQ ID NO: 5656 - DNA, 70 bp, Homo Sapiens
gaatcaaatggaatggactgtaatggaatggattcgaatggaatcgaatggagtggactcaaatggaatg

SEQ ID NO: 5657 - DNA, 93 bp, Homo Sapiens
aacaagtggacgaaggatatgaacagacacttctcaagacatttatgcagccaacagacacacgaaaaaatgctcatcatcactggccatcag

SEQ ID NO: 5658 - DNA, 55 bp, Homo Sapiens
aaacggaaaaaaacggaattatcgaatggaatcgaatagaatcatcgaatggacc

SEQ ID NO: 5659 - DNA, 105 bp, Homo Sapiens
tggaaccgaacaaagtcatcaccgaatggaattgaaatgaatcataatcgaatggaatcaaatggcatcttcgaattgactcgaatgcaatcatccactgggctt

SEQ ID NO: 5660 - DNA, 84 bp, Homo Sapiens
aacggaatcacgcggaattatcgaatggaatcgaagagaatcatcgaatggactcgaatggaatcatctaatggaatggaatgg

SEQ ID NO: 5661 - DNA, 96 bp, Homo Sapiens
ggaatcaactcgattgcaatggaatgcaatggaaaggaatggaatgcaattaaagcgaatagaatggaatggaatggaatggaacggaatggaatg

SEQ ID NO: 5662 - DNA, 68 bp, Homo Sapiens
aaaacaaacaacaacgacaaatcatgagaccagagttaagaaacaatgagaccaggctgggtgtggtg

SEQ ID NO: 5663 - DNA, 80 bp, Homo Sapiens
aatcgaaaggaatgcaatattattgaacagaatcgaaaagaatggaatcaaatggaatggaacagagtggaatggactgc

SEQ ID NO: 5664 - DNA, 79 bp, Homo Sapiens
aaggaatcgaatggaagtgaatgaaattgaatcaacaggaatggaagggaatagaatagactgtaatggaatggactcg

SEQ ID NO: 5665 - DNA, 65 bp, Homo Sapiens
aacccgagtgcaatagaatggaatcgaatggaatggaatggaatggaatggaatggaatggagtc

SEQ ID NO: 5666 - DNA, 80 bp, Homo Sapiens
gaatggaattgaaaggaatggaatgcaatggaatggaatgggatggaatggaatgcaatggaatcaactcgattgcaatg

SEQ ID NO: 5667 - DNA, 101 bp, Homo Sapiens
gaaaaaaacggaattatcgaattgaatcaaatagaatcatcgaacggaccaaaatggaatcatctaatggaatggaatggaataatccatggactctaatg

SEQ ID NO: 5668 - DNA, 132 bp, Homo Sapiens
tggaatcatctaatggaatggaatggaataatccatggactcgaatgcaatcatcataaaatggaatcgaatggaatcaacatcaaatggaatcaaatgggatcattgaacggaattgaatggaatcgtcat

SEQ ID NO: 5669 - DNA, 101 bp, Homo Sapiens
gaaaaaaacggaattatcgaattgaatcgaatagaatcatcgaacggaccagaatggaatcatctaatggaatggaatggaataatccatggactcgaatg

SEQ ID NO: 5670 - DNA, 91 bp, Homo Sapiens
aaccactgcttaaggaaataagagagaacacaaacaaatggaaaaacgttccatgctcatggataggagaatcaatatcgtgaaaatggcc

SEQ ID NO: 5671 - DNA, 95 bp, Homo Sapiens
tatcgaatggaatggaaaggagtggagtagactcgaatagaatggactggaatgaaatagattcgaatggaatggaatggaatgaagtggactcg

SEQ ID NO: 5672 - DNA, 84 bp, Homo Sapiens
gtatcaacatcaaacggaaaaaaacggaattatcgaatggaatcatctaatggaatggaatggaataatccatggactcgaatg

SEQ ID NO: 5673 - DNA, 87 bp, Homo Sapiens
taaatggagacatcattgaatacaattgaatggaatcatcacatggaatcgaatggaatcatcgtaaatgcaatcaagtggaatcat

SEQ ID NO: 5674 - DNA, 83 bp, Homo Sapiens
gaatggaattgaaaggtatcaacaccaaacggaaaaaaaaacggaattatcgaatggaatcgaagagaatcatcgaacggacc

SEQ ID NO: 5675 - DNA, 73 bp, Homo Sapiens
agcaatttcagcaaagtctcaggatacaaaatcaatgtacaaattcacaagcattcttatggaccaacaacag

SEQ ID NO: 5676 - DNA, 68 bp, Homo Sapiens
ggaatcgaatggcatcaacatcaaacggaaaaaaacggaattatcgaatggaatcgaatggaatcatc

SEQ ID NO: 5677 - DNA, 90 bp, Homo Sapiens
aaacaaaacacagaaatgcaaagacaaaacataaaacgcagccataaaggacatattttagataactggggaaatttgtatgggctgtgt

SEQ ID NO: 5678 - DNA, 103 bp, Homo Sapiens
aatggaatcaacatcaaacggaatcaaacggaattatcgaatggaatcgaagagaatcatcgaacggactcgaatggaatcatctaatggaatggaatggaag

SEQ ID NO: 5679 - DNA, 75 bp, Homo Sapiens
aatcgaatggaatcagcatcaaacggaaaaaaacggaattatcgaatggaatcgaagagaatcatcgaatggacc

SEQ ID NO: 5680 - DNA, 94 bp, Homo Sapiens
aaacggaattatagaatggactggaagagaatcatcgaacggactagaatggaatcatctaatcgaatggaatggaacaatccatggtctagca

SEQ ID NO: 5681 - DNA, 105 bp, Homo Sapiens
tgaacagagaattggacaaaacgcacaaagtaaagaaaaagaatgaagcaacaaaagcagagatttattgaaaacaaaagtacacaccacacagggtgggagtgg

SEQ ID NO: 5682 - DNA, 99 bp, Homo Sapiens
atcataacgacaagaacaaattcacacacaacaatattaacttcaaatccaaatgggttaaatgctccaattaaaggatgcagacgggcaaattggata

SEQ ID NO: 5683 - DNA, 99 bp, Homo Sapiens
atcataacgacaagaacaaattcacacacaacaatattcacttcaaatccaaatgggttaaatgctccaattaaaggatgcagacgggcaaattggata

SEQ ID NO: 5684 - DNA, 94 bp, Homo Sapiens
gaatggaatcgaatggattgatatcaactggaatggaatggaagggaatggaatggaatggaattgaaccaaatgtaatgacttgaatggaatg

SEQ ID NO: 5685 - DNA, 66 bp, Homo Sapiens
gaatcaacatcaaacggaaaaaaacggaattatcgaatggaatcgaagagaatcatcgaatggacc

SEQ ID NO: 5686 - DNA, 67 bp, Homo Sapiens
ggaatcaacatcaaacggaaaaaaacggaattatcgaatggaatcgaagagaatcatcgaatggacc

SEQ ID NO: 5687 - DNA, 135 bp, Homo Sapiens
atggaatcaacatcaaacggaatcaaacggaattatcgaatggaatcaaagagaatcatcgaacggactcgaatggaatcatctaatggaatggaatggaagaatccatggactcgaatgcaatcatcatcgaat

SEQ ID NO: 5688 - DNA, 52 bp, Homo Sapiens
ggaatggaatggaatggagccgaatggaatggaatgtactcaaatggaatgc

SEQ ID NO: 5689 - DNA, 150 bp, Homo Sapiens
aaaacacctaggaatacagataacaagggacattaactacctcttaaagagaactacaaaccactgctcaaggaaatgagagaggacacaaacacatggaaaaacattccatcctcatggataggaagaatcaatattgtgaaaatggcc

SEQ ID NO: 5690 - DNA, 98 bp, Homo Sapiens
aacacgactttgagaagagtaagtgattgttaattaaagcaagagaattattgatgtatcacagtcatgagaaatattggaaggaatatggtccatac

SEQ ID NO: 5691 - DNA, 66 bp, Homo Sapiens
acacatatcaaacaaacaaaagcaattgactatctagaaatgtctgggaaatggcaagatattaca

SEQ ID NO: 5692 - DNA, 86 bp, Homo Sapiens
ggaatcatcatataatggaatcgaatggaatcaacatcaaatggaatcaaatggaatcattgaacggaattgaatggaatcgtcat

SEQ ID NO: 5693 - DNA, 206 bp, Homo Sapiens
aatggaatcaacatcaaacggaatcaaatggaattatcgaatggaatcgaagagaatcatcgaattgtcacgaatggaatcatctaatggaatggaatggaataatccatggcccctatgcaatggactcgaatgaaatcatcatcaaacagaatcgaatggaatcatctaatggaatggaatggcataatccatggactcgaatg

SEQ ID NO: 5694 - DNA, 91 bp, Homo Sapiens
taaaatgaaacaaatatacaacacgaaggttatcaccagaaatatgccaaaacttaaatatgagaataagacagtctcaggggccacagag

SEQ ID NO: 5695 - DNA, 59 bp, Homo Sapiens
aaaatacagcgttatgaaaagaatgaacacacacacacacacacacacacagaaaatgt

SEQ ID NO: 5696 - DNA, 138 bp, Homo Sapiens
caaacaaataggtaccaaacaaataacaacataaacctgacaacacacttatttacaagagacatcccttatatgaaagggtacagaaaagtcgatggtaagatgatggggaaaggtataccaaccactagcagaagg

SEQ ID NO: 5697 - DNA, 93 bp, Homo Sapiens
tggaatcgaatggaatcaatatcaaacggaaaaaaacggaattatcgaatggaatcgaaaagaatcatcgaatgggcccgaatggaatcatct

SEQ ID NO: 5698 - DNA, 85 bp, Homo Sapiens
acaaatggaatcaacaacgaatggaatcgaatggaaacgccatcgaaaggaaacgaatggaattatcatgaaattgaaatggatg

SEQ ID NO: 5699 - DNA, 80 bp, Homo Sapiens
aatcaataaatgtaaaccagcatataaacagaaccaacgacaaaaaccacatgattatctcaatagatgcagaaaaggcc

SEQ ID NO: 5700 - DNA, 94 bp, Homo Sapiens
aaaataaacgcaaattaaaatcacaagataccaacacattcccacggctaagtacgaagaacaagggcgaatggtcagaattaagctcaaacct

SEQ ID NO: 5701 - DNA, 95 bp, Homo Sapiens
caacatcaaacggaatcaaacggaattatcgaatggaatcgaagagaatcatcgaatggactcgaatggaatcatctaatggaatggaatggaag

SEQ ID NO: 5702 - DNA, 60 bp, Homo Sapiens
acatcaaacggaaaaaaacggaattatcgaatggaatcgaagagaatcatcgaatggacc

SEQ ID NO: 5703 - DNA, 70 bp, Homo Sapiens
aatggactcgaatagaattgactggaatggaatggactcgaatggaatggaatggaatggaagggactcg

SEQ ID NO: 5704 - DNA, 138 bp, Homo Sapiens
aagaaagacagagaacaaacgtaattcaagatgactgattacatatccaagaacattagatggtcaaagactttaagaaggaatacattcaaaggcaaaacgtcacttactgattttggtggagtttgccacatggac

SEQ ID NO: 5705 - DNA, 83 bp, Homo Sapiens
gaatggaatcgaatggaatgaacatcaaacggaaaaaaacggaattatcgaatggaatcaaagagaatcatcgaatggacccg

SEQ ID NO: 5706 - DNA, 96 bp, Homo Sapiens
atggactcgaatgtaataatcattgaacggaatcgaatggaatcatcatcggatggaaacgaatggaatcatcatcgaatggaatcgaatgggatc

SEQ ID NO: 5707 - DNA, 66 bp, Homo Sapiens
gaaatggaatggaaaggaataaaatcaagtgaaattggatggaatggattggaatggattggaatg

SEQ ID NO: 5708 - DNA, 98 bp, Homo Sapiens
aaacggaaaaaaaacggaattatcgaatggaatcgaagagaatcatcgaacgaaccagaatggaatcatctaatggaatggaatggaataatccatgg

SEQ ID NO: 5709 - DNA, 78 bp, Homo Sapiens
attaacccgaatagaatggaatggaatggaatggaacggaacggaatggaatggaatggaatggaatggaatggatcg

SEQ ID NO: 5710 - DNA, 61 bp, Homo Sapiens
aacatcaaacggaaaaaaacggaattatcgtatggaatcgaagagaatcatcgaatggacc

SEQ ID NO: 5711 - DNA, 86 bp, Homo Sapiens
gaatagaattgaatcatcattgaatggaatcgagtagaatcattgaaatcgaatggaatcatcatcgaatggaattgggtggaatc

SEQ ID NO: 5712 - DNA, 80 bp, Homo Sapiens
caccgaatagaatcgaatggaacaatcatcgaatggactcaaatggaattatcctcaaatggaatcgaatggaattatcg

SEQ ID NO: 5713 - DNA, 68 bp, Homo Sapiens
aatgcaatcgaatagaatcatcgaatagactcgaatggaatcatcgaatggaatggaatggaacagtc

SEQ ID NO: 5714 - DNA, 85 bp, Homo Sapiens
aaatcatcatcgaatggaatcgaatggtatcattgaatggaatcgaatggaatcatcatcagatggaaatgaatggaatcgtcat

SEQ ID NO: 5715 - DNA, 95 bp, Homo Sapiens
gaatggaatcgaaaggaatagaatggaatggatcgttatggaaagacatcgaatggaatggaattgactcgaatggaatggactggaatggaacg

SEQ ID NO: 5716 - RNA, 778 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5717 - RNA, 761 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuggucuuugaauaaagccugaguaggaag

SEQ ID NO: 5718 - RNA, 1549 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguacccccguggucuuugaauaaagucugagugggcggc

SEQ ID NO: 5719 - RNA, 1532 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucuuggucuuugaauaaagccugaguaggaag

SEQ ID NO: 5720 - RNA, 778 nt, Artificial Sequence; identical to SEQ ID NO: 5716
  Description of Artificial Sequence: Synthetic Transcript Sequence

SEQ ID NO: 5721 - DNA, 832 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggattcgtcagtagggttgtaaaggtttttcttttcctgagaaaacaaccttttgttttctcaggttttgctttttggcctttccctagctttaaaaaaaaaaaagcaaaagtggtctttgaataaagtctgagtgggcggctctaga

SEQ ID NO: 5722 - RNA, 809 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggauucgucaguaggguuguaaagguuuuucuuuuccugagaaaacaaccuuuuguuuucucagguuuugcuuuuuggccuuucccuagcuuuaaaaaaaaaaaagcaaaaguggucuuugaauaaagucugagugggcggc

SEQ ID NO: 5723 - DNA, 928 bp, Artificial Sequence
  Description of Artificial Sequence: Synthetic Transcript Sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataataggattcgtcagtagggttgtaaaggtttttcttttcctgagaaaacaaccttttgttttctcaggttttgctttttggcctttccctagctttaaaaaaaaaaaagcaaaagtggtctttgaataaagtctgagtgggcggctctaga

SEQ ID NO: 5724 - RNA, 905 nt, Artificial Sequence
  Description of Artificial Sequence: Synthetic Transcript Sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaauaggauucgucaguaggguuguaaagguuuuucuuuuccugagaaaacaaccuuuuguuuucucagguuuugcuuuuuggccuuucccuagcuuuaaaaaaaaaaaagcaaaaguggucuuugaauaaagucugagugggcggc

SEQ ID NO: 5725 - DNA, 834 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataatagtgctcttcagtagggtcatgaaggtttttcttttcctgagaaaacaacacgtattgttttctcaggttttgctttttggcctttttctagcttaaaaaaaaaaaaagcaaaagtggtctttgaataaagtctgagtgggcggctctaga

SEQ ID NO: 5726 - RNA, 811 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauagugcucuucaguagggucaugaagguuuuucuuuuccugagaaaacaacacguauuguuuucucagguuuugcuuuuuggccuuuuucuagcuuaaaaaaaaaaaaagcaaaaguggucuuugaauaaagucugagugggcggc

SEQ ID NO: 5727 - DNA, 930 bp, Artificial Sequence
  Description of Artificial Sequence: Synthetic Transcript Sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataatagtgctcttcagtagggtcatgaaggtttttcttttcctgagaaaacaacacgtattgttttctcaggttttgctttttggcctttttctagcttaaaaaaaaaaaaagcaaaagtggtctttgaataaagtctgagtgggcggctctaga

SEQ ID NO: 5728 - RNA, 907 nt, Artificial Sequence
  Description of Artificial Sequence: Synthetic Transcript Sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaauagugcucuucaguagggucaugaagguuuuucuuuuccugagaaaacaacacguauuguuuucucagguuuugcuuuuuggccuuuuucuagcuuaaaaaaaaaaaaagcaaaaguggucuuugaauaaagucugagugggcggc

SEQ ID NO: 5729 - DNA, 47 bp, Artificial Sequence; identical to SEQ ID NO: 6
  Description of Artificial Sequence: Synthetic UTR

SEQ ID NO: 5730 - DNA, 145 bp, Artificial Sequence; identical to SEQ ID NO: 7
  Description of Artificial Sequence: Synthetic UTR

SEQ ID NO: 5731 - RNA, 42 nt, Artificial Sequence; identical to SEQ ID NO: 8
  Description of Artificial Sequence: Synthetic UTR

SEQ ID NO: 5732 - DNA, 47 bp, Artificial Sequence
  Description of Artificial Sequence: Synthetic UTR
gggaattaacagagaaaagaagagtaagaagaaatataagagccacc

SEQ ID NO: 5733 - DNA, 47 bp, Artificial Sequence
  Description of Artificial Sequence: Synthetic UTR
gggaaattagacagaaaagaagagtaagaagaaatataagagccacc

SEQ ID NO: 5734 - DNA, 47 bp, Artificial Sequence
  Description of Artificial Sequence: Synthetic UTR
gggaaataagagagtaaagaacagtaagaagaaatataagagccacc

SEQ ID NO: 5735 - DNA, 47 bp, Artificial Sequence
  Description of Artificial Sequence: Synthetic UTR
gggaaaaaagagagaaaagaagactaagaagaaatataagagccacc

SEQ ID NO: 5736 - DNA, 47 bp, Artificial Sequence
  Description of Artificial Sequence: Synthetic UTR
gggaaataagagagaaaagaagagtaagaagatatataagagccacc

SEQ ID NO: 5737 - DNA, 47 bp, Artificial Sequence
  Description of Artificial Sequence: Synthetic UTR
gggaaataagagacaaaacaagagtaagaagaaatataagagccacc

SEQ ID NO: 5738 - DNA, 47 bp, Artificial Sequence
  Description of Artificial Sequence: Synthetic UTR
gggaaattagagagtaaagaacagtaagtagaattaaaagagccacc

SEQ ID NO: 5739 - DNA, 47 bp, Artificial Sequence
  Description of Artificial Sequence: Synthetic UTR
gggaaataagagagaatagaagagtaagaagaaatataagagccacc

SEQ ID NO: 5740 - DNA, 47 bp, Artificial Sequence
  Description of Artificial Sequence: Synthetic UTR
gggaaataagagagaaaagaagagtaagaagaaaattaagagccacc

SEQ ID NO: 5741 - DNA, 47 bp, Artificial Sequence
  Description of Artificial Sequence: Synthetic UTR
gggaaataagagagaaaagaagagtaagaagaaatttaagagccacc

SEQ ID NO: 5742 - DNA, 47 bp, Artificial Sequence
  Description of Artificial Sequence: Synthetic UTR
gggaaataagagagaaaagaagagtaagaagaaatataagagcctcc

SEQ ID NO: 5743 - DNA, 41 bp, Artificial Sequence
  Description of Artificial Sequence: Synthetic UTR
gggaaataagagagaaaagaagagtaagaagaaatatatga

SEQ ID NO: 5744 - DNA, 38 bp, Artificial Sequence
  Description of Artificial Sequence: Synthetic UTR
gggaaataagagagaaaagaagagtaagaagaaatata

SEQ ID NO: 5745 - RNA, 758 nt, Artificial Sequence; identical to SEQ ID NO: 4258
  Description of Artificial Sequence: Synthetic Transcript Sequence

SEQ ID NO: 5746 - RNA, 1536 nt, Artificial Sequence
  Description of Artificial Sequence: Synthetic Transcript Sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 5747 - RNA, 725 nt, Artificial Sequence
  Description of Artificial Sequence: Synthetic Transcript Sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 5748 - RNA, 854 nt, Artificial Sequence
  Description of Artificial Sequence: Synthetic Transcript Sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 5749 - RNA, 758 nt, Artificial Sequence; identical to SEQ ID NO: 4266
  Description of Artificial Sequence: Synthetic Transcript Sequence

SEQ ID NO: 5750 - RNA, 780 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuccauaaaguaggaacacuacauggucuuugaauaaagccugaguaggaag

SEQ ID NO: 5751 - RNA, 765 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuacacuacuggucuuugaauaaagccugaguaggaag

SEQ ID NO: 5752 - RNA, 773 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuccauaaaguaggaauggucuuugaauaaagccugaguaggaag

SEQ ID NO: 5753 - RNA, 1799 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaauaggcugccuucugcggggcuugccuucuggccaugcccuucuucucucccuugcaccuguaccucuuggucuuugaauaaagccugaguaggaag

SEQ ID NO: 5754 - RNA, 1821 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaauaggcugccuucugcggggcuugccuucuggccaugcccuucuucucucccuugcaccuguaccucucaaacaccauugucacacuccauggucuuugaauaaagccugaguaggaag

SEQ ID NO: 5755 - RNA, 778 nt, Artificial Sequence
  Description of Artificial Sequence: Synthetic Transcript Sequence
gggaaauaagagagaaaagaagaguaagaagaaauauaagagccuccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5756 - RNA, 778 nt, Artificial Sequence
  Description of Artificial Sequence: Synthetic Transcript Sequence
gggaaauaagagagaaaagaagaguaagaagaaauauaugagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5757 - RNA, 769 nt, Artificial Sequence
  Description of Artificial Sequence: Synthetic Transcript Sequence
gggaaauaagagagaaaagaagaguaagaagaaauauaauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 5758 - RNA, 893 nt, Artificial Sequence
  Description of Artificial Sequence: Synthetic Transcript Sequence
gggaaauucugacauccggcggaauucugacauccggcggaauucugacauccggcggaauucugacauccggcggaauucugacauccggcggaagacucacaaccccagaaacagacauuaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

The invention claimed is:

1. A method of reducing a protein antigen-mediated immune response in a subject, comprising administering to the subject a composition comprising a chemically modified mRNA and a pharmaceutically acceptable carrier, wherein the chemically modified mRNA comprises
  (a) a 5' untranslated region (5' UTR);
  (b) a region of linked nucleosides encoding said protein antigen;
  (c) a 3' untranslated region (3' UTR) comprising at least one miR-142-3p microRNA binding site; and
  (d) a 3' tailing region of linked nucleosides,
    wherein the chemically modified mRNA comprises fully modified 1-methyl pseudouridine nucleosides, and optionally comprises fully modified 5' methylcytidine nucleosides, thereby reducing the protein antigen-mediated immune response in the subject.

2. The method of claim 1, wherein the first region of linked nucleosides is codon optimized.

3. The method of claim 1, wherein the chemically modified mRNA comprises fully modified 1-methyl pseudouridine nucleosides without fully modified 5' methyl-cytidine nucleosides.

4. The method of claim 1, wherein the chemically modified mRNA comprises fully modified 1-methyl pseudouridine nucleosides and fully modified 5' methyl-cytidine nucleosides.

5. The method of claim 1, wherein the miR-142-3p microRNA binding site comprises the sequence set forth in SEQ ID NO: 1404.

6. The method of claim 1, wherein the 3' tailing region of linked nucleosides comprises a poly A tail of at least 100, at least 120, or at least 140 nucleosides.

7. The method of claim 1, wherein the chemically modified mRNA further comprises a 5' cap structure.

8. The method of claim 7, wherein the 5' cap structure comprises Cap1.

9. The method of claim 1, wherein the protein antigen is a therapeutic protein, cytokine, growth factor, antibody or fusion protein.

10. The method of claim 1, wherein the chemically modified mRNA is formulated with a liposome, lipoplex, or lipid nanoparticle.

11. The method of claim 10, wherein the chemically modified mRNA is formulated with a lipid nanoparticle.

12. The method of claim 11, wherein the lipid nanoparticle comprises a cationic or ionizable lipid.

13. The method of claim 12, wherein the cationic lipid is selected from the group consisting of DLin-MC3-DMA, DLin-DMA, C12-200 and DLin-KC2-DMA.

* * * * *